United States Patent 10,463,711 (NUTRITIVE POLYPEPTIDES AND FORMULATIONS THEREOF, AND METHODS OF PRODUCTION AND USE THEREOF) - sequence listing, part 6

SEQ ID NO: 34883 - protein, 234 aa, Staphylococcus aureus
  subsp. aureus 21269
MKMTAIAKASLALGILATGTITSTHQTVNASEHEAKYENVTKDIFDLRDYYSGASKELKNVTGYRYSKGGKHYLIFDKHQKFTRIQIFGKDIERLKTRKNPGLDIFVVKEAENRNGTVFSYGGVTKKNQGAYYDYLNAPKFVIKKEVDAGVYTHVKRHYIYKEEVSLKELDFKLRQYLIQNFDLYKKFPKDSKIKVIMKDGGYYTFELNKKLQPHRMSDVIDGRNIEKIEANIR

SEQ ID NO: 34884 - protein, 133 aa, Staphylococcus aureus
  subsp. aureus 21269
MHFLVIEEEPVKGRQYSIGGISKTNSKEFKEREVDVKVTRKADKDTTSTKDSKFKITKEEISLKELDFKLRQKLMKEENLYDAVNNRKGKIVVKMEDDKFYTFELTKKLQPHRMGDTIDGTKIKEINVELEYK

SEQ ID NO: 34885 - protein, 231 aa, Staphylococcus aureus
  subsp. aureus 21269
MKLKTLAKATLALGLLTTGVITSEGQAVHAKEKQERVQHLYDIQDLHRYYSSESFDFSNISGKVENYNGSNVVRFNQDGQNHQLFLLGEDKAKYKQGLEGQNVFVVKELIDPNGRLSTVGGVTKKNNQSSETNTPLFVKKVYGGNLDASIESFSINKEEVSLKELDFKIRQHLVKNYGLYKGTTKYGKITFNLKDGEKKEIDLGDKLQFEHMGDVLNSKDIQNIAVTINQI

SEQ ID NO: 34886 - protein, 232 aa, Staphylococcus aureus
  subsp. aureus 21269
MKFTSIAKAIFVLGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKGGFSIDEFFFIQKEEVSLKELDFKIRKLLIKKYKLYEGSADKGRIVINMKDENKYEIDLSDKLDFERMADVISSEQIKNIEVNLK

SEQ ID NO: 34887 - protein, 103 aa, Staphylococcus aureus
  subsp. aureus 21269
MFGFVSNPSLQVKKVDAKNGFSINELFFIQKEEVSLKELDFKIRKLLIEKYRLYKGTADKGRIVINMKDEKKHEIDLSEKLSFERMFDVMDSKKIKNIEVNLN

SEQ ID NO: 34888 - protein, 157 aa, Staphylococcus aureus
  subsp. aureus 21269
MKFTALAKATLALGILTTGTLTTEAHSSHAKQNQESVNKHDKEALYRYYTGKTMELKNINALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKKK

SEQ ID NO: 34889 - protein, 61 aa, Staphylococcus aureus; identical to SEQ ID NO: 33840
  subsp. aureus 21269

SEQ ID NO: 34890 - protein, 231 aa, Staphylococcus aureus; identical to SEQ ID NO: 33532
  subsp. aureus 21269

SEQ ID NO: 34891 - protein, 258 aa, Staphylococcus aureus; identical to SEQ ID NO: 30228
  subsp. aureus 21272

SEQ ID NO: 34892 - protein, 268 aa, Staphylococcus aureus; identical to SEQ ID NO: 30398
  subsp. aureus 21272

SEQ ID NO: 34893 - protein, 259 aa, Staphylococcus aureus; identical to SEQ ID NO: 30226
  subsp. aureus 21272

SEQ ID NO: 34894 - protein, 1153 aa, Staphylococcus aureus
  subsp. aureus 21272
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34895 - protein, 1385 aa, Staphylococcus aureus; identical to SEQ ID NO: 30595
  subsp. aureus 21272

SEQ ID NO: 34896 - protein, 967 aa, Staphylococcus aureus; identical to SEQ ID NO: 34172
  subsp. aureus 21272

SEQ ID NO: 34897 - protein, 331 aa, Staphylococcus aureus; identical to SEQ ID NO: 30615
  subsp. aureus 21272

SEQ ID NO: 34898 - protein, 327 aa, Staphylococcus aureus; identical to SEQ ID NO: 30616
  subsp. aureus 21272

SEQ ID NO: 34899 - protein, 311 aa, Staphylococcus aureus; identical to SEQ ID NO: 30617
  subsp. aureus 21272

SEQ ID NO: 34900 - protein, 258 aa, Staphylococcus aureus; identical to SEQ ID NO: 30410
  subsp. aureus 21272

SEQ ID NO: 34901 - protein, 251 aa, Staphylococcus aureus
  subsp. aureus 21272
MRLFYIAAIIITLLCLINNNYVNAEVDKKDLKKKSDLDSSKLFNLTSYYTDITWQLDESNKISTDQLLNNTIILKNIDISVLKTSSLKVEFNSSDLANQFKGKNIDIYGLYFGNKCVGLTEEKTSCLYGGVTIHDGNQLDEEKVIGVNVFKDGVQQEVFVIKTKKAKVTVQELDTKVRFKLENLYKIYNKDTGNIQKGCIFFHSHNHQDQSFYYDLYNVKGSVGAEFFQFYSDNRTVSSSNYHIDVFLYKD

SEQ ID NO: 34902 - protein, 37 aa, Staphylococcus aureus; identical to SEQ ID NO: 30806
  subsp. aureus 21272

SEQ ID NO: 34903 - protein, 242 aa, Staphylococcus aureus; identical to SEQ ID NO: 30399
  subsp. aureus 21272

SEQ ID NO: 34904 - protein, 239 aa, Staphylococcus aureus; identical to SEQ ID NO: 30622
  subsp. aureus 21272

SEQ ID NO: 34905 - protein, 254 aa, Staphylococcus aureus; identical to SEQ ID NO: 30809
  subsp. aureus 21272

SEQ ID NO: 34906 - protein, 62 aa, Staphylococcus aureus; identical to SEQ ID NO: 30610
  subsp. aureus 21272

SEQ ID NO: 34907 - protein, 138 aa, Staphylococcus aureus; identical to SEQ ID NO: 30785
  subsp. aureus 21272

SEQ ID NO: 34908 - protein, 291 aa, Staphylococcus aureus; identical to SEQ ID NO: 30390
  subsp. aureus 21272

SEQ ID NO: 34909 - protein, 891 aa, Staphylococcus aureus
  subsp. aureus 21272
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKIVSSIEYGENIHEDYDYTLMAFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVFKDADNNIDKDVQHDVDHLSDMSDNNHFDKYDLKEMDTQIAKDTDRNVDNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 34910 - protein, 2186 aa, Staphylococcus aureus; identical to SEQ ID NO: 30516
  subsp. aureus 21272

SEQ ID NO: 34911 - protein, 938 aa, Staphylococcus aureus; identical to SEQ ID NO: 30838
  subsp. aureus 21272

SEQ ID NO: 34912 - protein, 1015 aa, Staphylococcus aureus; identical to SEQ ID NO: 30839
  subsp. aureus 21272

SEQ ID NO: 34913 - protein, 233 aa, Staphylococcus aureus; identical to SEQ ID NO: 30591
  subsp. aureus 21272

SEQ ID NO: 34914 - protein, 211 aa, Staphylococcus aureus; identical to SEQ ID NO: 30592
  subsp. aureus 21272

SEQ ID NO: 34915 - protein, 877 aa, Staphylococcus aureus
  subsp. aureus 21272
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTANNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSESDSDSDSDSDSESDSDSDSDSDSDSDSDSESDSDSESDSESDSDSDSDSDSDSDSDSDSDSDSDSDSDSDSDSDSDSESDSDSDSDSDSESDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 34916 - protein, 2297 aa, Staphylococcus aureus
  subsp. aureus 21272
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 34917 - protein, 681 aa, Staphylococcus aureus; identical to SEQ ID NO: 30598
  subsp. aureus 21272

SEQ ID NO: 34918 - protein, 405 aa, Staphylococcus aureus
  subsp. aureus 21272
MKLKKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34919 - protein, 85 aa, Staphylococcus aureus
  subsp. aureus 21272
MKKKNIYSIRKLGVGIASVTLGTLLISGGVTPAANAAQHDEAQQNAFYQVLNMPNLNADQRNGFIQSLKDDPSQSANVLGEAQKT

SEQ ID NO: 34920 - protein, 241 aa, Staphylococcus aureus; identical to SEQ ID NO: 30571
  subsp. aureus 21272

SEQ ID NO: 34921 - protein, 691 aa, Staphylococcus aureus; identical to SEQ ID NO: 30511
  subsp. aureus 21272

SEQ ID NO: 34922 - protein, 203 aa, Staphylococcus aureus; identical to SEQ ID NO: 30576
  subsp. aureus 21272

SEQ ID NO: 34923 - protein, 226 aa, Staphylococcus aureus; identical to SEQ ID NO: 30577
  subsp. aureus 21272

SEQ ID NO: 34924 - protein, 231 aa, Staphylococcus aureus; identical to SEQ ID NO: 30578
  subsp. aureus 21272

SEQ ID NO: 34925 - protein, 356 aa, Staphylococcus aureus; identical to SEQ ID NO: 30793
  subsp. aureus 21272

SEQ ID NO: 34926 - protein, 292 aa, Staphylococcus aureus; identical to SEQ ID NO: 30580
  subsp. aureus 21272

SEQ ID NO: 34927 - protein, 234 aa, Staphylococcus aureus; identical to SEQ ID NO: 30581
  subsp. aureus 21272

SEQ ID NO: 34928 - protein, 231 aa, Staphylococcus aureus; identical to SEQ ID NO: 30582
  subsp. aureus 21272

SEQ ID NO: 34929 - protein, 232 aa, Staphylococcus aureus; identical to SEQ ID NO: 30583
  subsp. aureus 21272

SEQ ID NO: 34930 - protein, 232 aa, Staphylococcus aureus; identical to SEQ ID NO: 30584
  subsp. aureus 21272

SEQ ID NO: 34931 - protein, 227 aa, Staphylococcus aureus; identical to SEQ ID NO: 30585
  subsp. aureus 21272

SEQ ID NO: 34932 - protein, 227 aa, Staphylococcus aureus; identical to SEQ ID NO: 30586
  subsp. aureus 21272

SEQ ID NO: 34933 - protein, 351 aa, Staphylococcus aureus; identical to SEQ ID NO: 30628
  subsp. aureus 21272

SEQ ID NO: 34934 - protein, 338 aa, Staphylococcus aureus; identical to SEQ ID NO: 30627
  subsp. aureus 21272

SEQ ID NO: 34935 - protein, 330 aa, Staphylococcus aureus
  subsp. aureus 21272
MVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGHSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 34936 - protein, 96 aa, Staphylococcus aureus; identical to SEQ ID NO: 30813
  subsp. aureus 21272

SEQ ID NO: 34937 - protein, 165 aa, Staphylococcus aureus; identical to SEQ ID NO: 30418
  subsp. aureus 21272

SEQ ID NO: 34938 - protein, 109 aa, Staphylococcus aureus; identical to SEQ ID NO: 30603
  subsp. aureus 21272

SEQ ID NO: 34939 - protein, 350 aa, Staphylococcus aureus; identical to SEQ ID NO: 30602
  subsp. aureus 21272

SEQ ID NO: 34940 - protein, 645 aa, Staphylococcus aureus; identical to SEQ ID NO: 30601
  subsp. aureus 21272

SEQ ID NO: 34941 - protein, 2481 aa, Staphylococcus aureus
  subsp. aureus 21272
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGTTNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 34942 - protein, 231 aa, Staphylococcus aureus
  subsp. aureus 21272
MKKTLLASSLAVGLGIVAGNAGHEAHASEADLNKASLAQMAQSNDQTLNQKPIEAGAYNYTFDYEGFTYHFESDGTHFAWNYHATGANGANMSAQEPATNNVEPSAVQANQVQSQEVEAPQNAQTQQPQASTSNNSQVTATPTESKASEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 34943 - protein, 141 aa, Staphylococcus aureus; identical to SEQ ID NO: 30633
  subsp. aureus 21272

SEQ ID NO: 34944 - protein, 809 aa, Staphylococcus aureus; identical to SEQ ID NO: 30632
  subsp. aureus 21272

SEQ ID NO: 34945 - protein, 321 aa, Staphylococcus aureus; identical to SEQ ID NO: 30959
  subsp. aureus 21272

SEQ ID NO: 34946 - protein, 315 aa, Staphylococcus aureus; identical to SEQ ID NO: 30573
  subsp. aureus 21272

SEQ ID NO: 34947 - protein, 325 aa, Staphylococcus aureus; identical to SEQ ID NO: 30407
  subsp. aureus 21272

SEQ ID NO: 34948 - protein, 241 aa, Staphylococcus aureus; identical to SEQ ID NO: 32458
  subsp. aureus 21272

SEQ ID NO: 34949 - protein, 372 aa, Staphylococcus aureus; identical to SEQ ID NO: 30609
  subsp. aureus 21272

SEQ ID NO: 34950 - protein, 241 aa, Staphylococcus aureus; identical to SEQ ID NO: 30608
  subsp. aureus 21272

SEQ ID NO: 34951 - protein, 241 aa, Staphylococcus aureus; identical to SEQ ID NO: 30607
  subsp. aureus 21272

SEQ ID NO: 34952 - protein, 238 aa, Staphylococcus aureus; identical to SEQ ID NO: 30606
  subsp. aureus 21272

SEQ ID NO: 34953 - protein, 319 aa, Staphylococcus aureus; identical to SEQ ID NO: 30605
  subsp. aureus 21272

SEQ ID NO: 34954 - protein, 989 aa, Staphylococcus aureus
  subsp. aureus 21272
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNVNDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 34955 - protein, 434 aa, Staphylococcus aureus [sequence omitted]

SEQ ID NO: 34956 - protein, 241 aa, Staphylococcus aureus; identical to SEQ ID NO: 30738
  subsp. aureus 21282

SEQ ID NO: 34957 - protein, 242 aa, Staphylococcus aureus; identical to SEQ ID NO: 30537
  subsp. aureus 21282

SEQ ID NO: 34958 - protein, 895 aa, Staphylococcus aureus; identical to SEQ ID NO: 30734
  subsp. aureus 21282

SEQ ID NO: 34959 - protein, 644 aa, Staphylococcus aureus; identical to SEQ ID NO: 31782
  subsp. aureus 21282

SEQ ID NO: 34960 - protein, 165 aa, Staphylococcus aureus; identical to SEQ ID NO: 30742
  subsp. aureus 21282

SEQ ID NO: 34961 - protein, 319 aa, Staphylococcus aureus; identical to SEQ ID NO: 30741
  subsp. aureus 21282

SEQ ID NO: 34962 - protein, 242 aa, Staphylococcus aureus; identical to SEQ ID NO: 30536
  subsp. aureus 21282

SEQ ID NO: 34963 - protein, 238 aa, Staphylococcus aureus; identical to SEQ ID NO: 30740
  subsp. aureus 21282

SEQ ID NO: 34964 - protein, 241 aa, Staphylococcus aureus; identical to SEQ ID NO: 30739
  subsp. aureus 21282

SEQ ID NO: 34965 - protein, 102 aa, Staphylococcus aureus
  subsp. aureus 21282
SDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 34966 - protein, 350 aa, Staphylococcus aureus; identical to SEQ ID NO: 30602
  subsp. aureus 21282

SEQ ID NO: 34967 - protein, 645 aa, Staphylococcus aureus; identical to SEQ ID NO: 30747
  subsp. aureus 21282

SEQ ID NO: 34968 - protein, 1315 aa, Staphylococcus aureus; identical to SEQ ID NO: 31844
  subsp. aureus 21282

SEQ ID NO: 34969 - protein, 947 aa, Staphylococcus aureus; identical to SEQ ID NO: 31843
  subsp. aureus 21282

SEQ ID NO: 34970 - protein, 933 aa, Staphylococcus aureus; identical to SEQ ID NO: 31851
  subsp. aureus 21282

SEQ ID NO: 34971 - protein, 291 aa, Staphylococcus aureus; identical to SEQ ID NO: 30390
  subsp. aureus 21282

SEQ ID NO: 34972 - protein, 434 aa, Staphylococcus aureus [sequence omitted]

SEQ ID NO: 34973 - protein, 266 aa, Staphylococcus aureus; identical to SEQ ID NO: 30401
  subsp. aureus 21282

SEQ ID NO: 34974 - protein, 311 aa, Staphylococcus aureus; identical to SEQ ID NO: 30617
  subsp. aureus 21282

SEQ ID NO: 34975 - protein, 250 aa, Staphylococcus aureus; identical to SEQ ID NO: 31910
  subsp. aureus 21282

SEQ ID NO: 34976 - protein, 109 aa, Staphylococcus aureus; identical to SEQ ID NO: 30744
  subsp. aureus 21282

SEQ ID NO: 34977 - protein, 327 aa, Staphylococcus aureus; identical to SEQ ID NO: 30538
  subsp. aureus 21282

SEQ ID NO: 34978 - protein, 351 aa, Staphylococcus aureus; identical to SEQ ID NO: 30720
  subsp. aureus 21282

SEQ ID NO: 34979 - protein, 338 aa, Staphylococcus aureus; identical to SEQ ID NO: 30699
  subsp. aureus 21282

SEQ ID NO: 34980 - protein, 741 aa, Staphylococcus aureus
  subsp. aureus 21282
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSD

SEQ ID NO: 34981 - protein, 2271 aa, Staphylococcus aureus; identical to SEQ ID NO: 31839
  subsp. aureus 21282

SEQ ID NO: 34982 - protein, 331 aa, Staphylococcus aureus; identical to SEQ ID NO: 30732
  subsp. aureus 21282

SEQ ID NO: 34983 - protein, 807 aa, Staphylococcus aureus; identical to SEQ ID NO: 30716
  subsp. aureus 21282

SEQ ID NO: 34984 - protein, 241 aa, Staphylococcus aureus; identical to SEQ ID NO: 30776
  subsp. aureus 21282

SEQ ID NO: 34985 - protein, 500 aa, Staphylococcus aureus
  subsp. aureus 21282
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 34986 - protein, 232 aa, Staphylococcus aureus; identical to SEQ ID NO: 31054
  subsp. aureus 21282

SEQ ID NO: 34987 - protein, 984 aa, Staphylococcus aureus
  subsp. aureus 21282
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDRGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSD

SEQ ID NO: 34988 - protein, 681 aa, Staphylococcus aureus; identical to SEQ ID NO: 32025
  subsp. aureus 21282

SEQ ID NO: 34989 - protein, 274 aa, Staphylococcus aureus; identical to SEQ ID NO: 30872
  subsp. aureus 21282

SEQ ID NO: 34990 - protein, 141 aa, Staphylococcus aureus; identical to SEQ ID NO: 30715
  subsp. aureus 21282

SEQ ID NO: 34991 - protein, 231 aa, Staphylococcus aureus; identical to SEQ ID NO: 31073
  subsp. aureus 21282

SEQ ID NO: 34992 - protein, 315 aa, Staphylococcus aureus; identical to SEQ ID NO: 30440
  subsp. aureus 21282

SEQ ID NO: 34993 - protein, 321 aa, Staphylococcus aureus; identical to SEQ ID NO: 30959
  subsp. aureus 21282

SEQ ID NO: 34994 - protein, 234 aa, Staphylococcus aureus; identical to SEQ ID NO: 31052
  subsp. aureus 21282

SEQ ID NO: 34995 - protein, 231 aa, Staphylococcus aureus; identical to SEQ ID NO: 30768
  subsp. aureus 21282

SEQ ID NO: 34996 - protein, 308 aa, Staphylococcus aureus; identical to SEQ ID NO: 31787
  subsp. aureus 21282

SEQ ID NO: 34997 - protein, 231 aa, Staphylococcus aureus; identical to SEQ ID NO: 31761
  subsp. aureus 21282

SEQ ID NO: 34998 - protein, 917 aa, Staphylococcus aureus; identical to SEQ ID NO: 31037
  subsp. aureus 21282

SEQ ID NO: 34999 - protein, 231 aa, Staphylococcus aureus; identical to SEQ ID NO: 30560
  subsp. aureus 21282

SEQ ID NO: 35000 - protein, 222 aa, Staphylococcus aureus
  subsp. aureus 21282
MRKKSELQGAALGNLKQIYYYNEKAKTENKESHDQFLQHTILFKGFFTNHSWYNDLLVDFDSKDIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVNYDLFGAQGQNSNTLLRIYRDNKTINSENMHIDIYLYTS

SEQ ID NO: 35001 - protein, 225 aa, Staphylococcus aureus; identical to SEQ ID NO: 30763
  subsp. aureus 21282

SEQ ID NO: 35002 - protein, 226 aa, Staphylococcus aureus; identical to SEQ ID NO: 30769
  subsp. aureus 21282

SEQ ID NO: 35003 - protein, 372 aa, Staphylococcus aureus; identical to SEQ ID NO: 31084
  subsp. aureus 21282

SEQ ID NO: 35004 - protein, 325 aa, Staphylococcus aureus; identical to SEQ ID NO: 30407
  subsp. aureus 21282

SEQ ID NO: 35005 - protein, 203 aa, Staphylococcus aureus; identical to SEQ ID NO: 30770
  subsp. aureus 21282

SEQ ID NO: 35006 - protein, 227 aa, Staphylococcus aureus; identical to SEQ ID NO: 30585
  subsp. aureus 21282

SEQ ID NO: 35007 - protein, 430 aa, Staphylococcus aureus
  subsp. aureus 21282
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKV

SEQ ID NO: 35008 - protein, 232 aa, Staphylococcus aureus; identical to SEQ ID NO: 30765
  subsp. aureus 21282

SEQ ID NO: 35009 - protein, 140 aa, Staphylococcus aureus; identical to SEQ ID NO: 32317
  subsp. aureus 21282

SEQ ID NO: 35010 - protein, 233 aa, Staphylococcus aureus; identical to SEQ ID NO: 30428
  subsp. aureus 21282

SEQ ID NO: 35011 - protein, 2478 aa, Staphylococcus aureus; identical to SEQ ID NO: 30559
  subsp. aureus 21282

SEQ ID NO: 35012 - protein, 995 aa, Staphylococcus aureus; identical to SEQ ID NO: 31038
  subsp. aureus 21282

SEQ ID NO: 35013 - protein, 352 aa, Staphylococcus aureus; identical to SEQ ID NO: 30767
  subsp. aureus 21282

SEQ ID NO: 35014 - protein, 96 aa, Staphylococcus aureus; identical to SEQ ID NO: 30813
  subsp. aureus 21282

SEQ ID NO: 35015 - protein, 241 aa, Staphylococcus aureus; identical to SEQ ID NO: 32458
  subsp. aureus 21282

SEQ ID NO: 35016 - protein, 2186 aa, Staphylococcus aureus; identical to SEQ ID NO: 31059
  subsp. aureus 21282

SEQ ID NO: 35017 - protein, 243 aa, Staphylococcus aureus
  subsp. aureus 21283
DPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 35018 - protein, 225 aa, Staphylococcus aureus; identical to SEQ ID NO: 30763
  subsp. aureus 21283

SEQ ID NO: 35019 - protein, 947 aa, Staphylococcus aureus; identical to SEQ ID NO: 31843
  subsp. aureus 21283

SEQ ID NO: 35020 - protein, 1315 aa, Staphylococcus aureus; identical to SEQ ID NO: 31844
  subsp. aureus 21283

SEQ ID NO: 35021 - protein, 984 aa, Staphylococcus aureus; identical to SEQ ID NO: 34987
  subsp. aureus 21283

SEQ ID NO: 35022 - protein, 242 aa, Staphylococcus aureus; identical to SEQ ID NO: 30537
  subsp. aureus 21283

SEQ ID NO: 35023 - protein, 242 aa, Staphylococcus aureus; identical to SEQ ID NO: 30536
  subsp. aureus 21283

SEQ ID NO: 35024 - protein, 234 aa, Staphylococcus aureus; identical to SEQ ID NO: 31052
  subsp. aureus 21283

SEQ ID NO: 35025 - protein, 308 aa, Staphylococcus aureus; identical to SEQ ID NO: 31787
  subsp. aureus 21283

SEQ ID NO: 35026 - protein, 352 aa, Staphylococcus aureus; identical to SEQ ID NO: 30767
  subsp. aureus 21283

SEQ ID NO: 35027 - protein, 231 aa, Staphylococcus aureus; identical to SEQ ID NO: 30768
  subsp. aureus 21283

SEQ ID NO: 35028 - protein, 226 aa, Staphylococcus aureus; identical to SEQ ID NO: 30769
  subsp. aureus 21283

SEQ ID NO: 35029 - protein, 203 aa, Staphylococcus aureus; identical to SEQ ID NO: 30770
  subsp. aureus 21283

SEQ ID NO: 35030 - protein, 807 aa, Staphylococcus aureus; identical to SEQ ID NO: 33724
  subsp. aureus 21283

SEQ ID NO: 35031 - protein, 96 aa, Staphylococcus aureus; identical to SEQ ID NO: 30813
  subsp. aureus 21283

SEQ ID NO: 35032 - protein, 180 aa, Staphylococcus aureus
  subsp. aureus 21283
SYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 35033 - protein, 2478 aa, Staphylococcus aureus; identical to SEQ ID NO: 30559
  subsp. aureus 21283

SEQ ID NO: 35034 - protein, 331 aa, Staphylococcus aureus; identical to SEQ ID NO: 30732
  subsp. aureus 21283

SEQ ID NO: 35035 - protein, 741 aa, Staphylococcus aureus; identical to SEQ ID NO: 34980
  subsp. aureus 21283

SEQ ID NO: 35036 - protein, 2271 aa, Staphylococcus aureus; identical to SEQ ID NO: 31839
  subsp. aureus 21283

SEQ ID NO: 35037 - protein, 102 aa, Staphylococcus aureus; identical to SEQ ID NO: 34965
  subsp. aureus 21283

SEQ ID NO: 35038 - protein, 351 aa, Staphylococcus aureus; identical to SEQ ID NO: 30720
  subsp. aureus 21283

SEQ ID NO: 35039 - protein, 338 aa, Staphylococcus aureus; identical to SEQ ID NO: 30699
  subsp. aureus 21283

SEQ ID NO: 35040 - protein, 274 aa, Staphylococcus aureus; identical to SEQ ID NO: 30872
  subsp. aureus 21283

SEQ ID NO: 35041 - protein, 231 aa, Staphylococcus aureus; identical to SEQ ID NO: 30560
  subsp. aureus 21283

SEQ ID NO: 35042 - protein, 232 aa, Staphylococcus aureus; identical to SEQ ID NO: 31054
  subsp. aureus 21283

SEQ ID NO: 35043 - protein, 232 aa, Staphylococcus aureus; identical to SEQ ID NO: 30765
  subsp. aureus 21283

SEQ ID NO: 35044 - protein, 227 aa, Staphylococcus aureus; identical to SEQ ID NO: 30585
  subsp. aureus 21283

SEQ ID NO: 35045 - protein, 474 aa, Staphylococcus aureus
  subsp. aureus 21283
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTG

SEQ ID NO: 35046 - protein, 166 aa, Staphylococcus aureus
  subsp. aureus 21283
NYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 35047 - protein, 241 aa, Staphylococcus aureus; identical to SEQ ID NO: 30776
  subsp. aureus 21283

SEQ ID NO: 35048 - protein, 508 aa, Staphylococcus aureus; identical to SEQ ID NO: 30777
  subsp. aureus 21283

SEQ ID NO: 35049 - protein, 372 aa, Staphylococcus aureus; identical to SEQ ID NO: 31084
  subsp. aureus 21283

SEQ ID NO: 35050 - protein, 241 aa, Staphylococcus aureus; identical to SEQ ID NO: 30738
  subsp. aureus 21283

SEQ ID NO: 35051 - protein, 241 aa, Staphylococcus aureus; identical to SEQ ID NO: 30739
  subsp. aureus 21283

SEQ ID NO: 35052 - protein, 238 aa, Staphylococcus aureus; identical to SEQ ID NO: 30740
  subsp. aureus 21283

SEQ ID NO: 35053 - protein, 319 aa, Staphylococcus aureus; identical to SEQ ID NO: 30741
  subsp. aureus 21283

SEQ ID NO: 35054 - protein, 165 aa, Staphylococcus aureus; identical to SEQ ID NO: 30742
  subsp. aureus 21283

SEQ ID NO: 35055 - protein, 109 aa, Staphylococcus aureus; identical to SEQ ID NO: 30744
  subsp. aureus 21283

SEQ ID NO: 35056 - protein, 350 aa, Staphylococcus aureus; identical to SEQ ID NO: 30602
  subsp. aureus 21283

SEQ ID NO: 35057 - protein, 645 aa, Staphylococcus aureus; identical to SEQ ID NO: 30747
  subsp. aureus 21283

SEQ ID NO: 35058 - protein, 933 aa, Staphylococcus aureus; identical to SEQ ID NO: 31851
  subsp. aureus 21283

SEQ ID NO: 35059 - protein, 434 aa, Staphylococcus aureus [sequence omitted]

SEQ ID NO: 35060 - protein, 311 aa, Staphylococcus aureus; identical to SEQ ID NO: 30617
  subsp. aureus 21283

SEQ ID NO: 35061 - protein, 327 aa, Staphylococcus aureus; identical to SEQ ID NO: 30538
  subsp. aureus 21283

SEQ ID NO: 35062 - protein, 257 aa, Staphylococcus aureus; identical to SEQ ID NO: 31220
  subsp. aureus 21283

SEQ ID NO: 35063 - protein, 231 aa, Staphylococcus aureus; identical to SEQ ID NO: 31073
  subsp. aureus 21283

SEQ ID NO: 35064 - protein, 895 aa, Staphylococcus aureus; identical to SEQ ID NO: 30734
  subsp. aureus 21283

SEQ ID NO: 35065 - protein, 231 aa, Staphylococcus aureus; identical to SEQ ID NO: 31761
  subsp. aureus 21283

SEQ ID NO: 35066 - protein, 321 aa, Staphylococcus aureus; identical to SEQ ID NO: 30959
  subsp. aureus 21283

SEQ ID NO: 35067 - protein, 315 aa, Staphylococcus aureus; identical to SEQ ID NO: 30440
  subsp. aureus 21283

SEQ ID NO: 35068 - protein, 325 aa, Staphylococcus aureus; identical to SEQ ID NO: 30407
  subsp. aureus 21283

SEQ ID NO: 35069 - protein, 2186 aa, Staphylococcus aureus; identical to SEQ ID NO: 31059
  subsp. aureus 21283

SEQ ID NO: 35070 - protein, 233 aa, Staphylococcus aureus; identical to SEQ ID NO: 30428
  subsp. aureus 21283

SEQ ID NO: 35071 - protein, 140 aa, Staphylococcus aureus; identical to SEQ ID NO: 32317
  subsp. aureus 21283

SEQ ID NO: 35072 - protein, 266 aa, Staphylococcus aureus; identical to SEQ ID NO: 30401
  subsp. aureus 21283

SEQ ID NO: 35073 - protein, 250 aa, Staphylococcus aureus; identical to SEQ ID NO: 31910
  subsp. aureus 21283

SEQ ID NO: 35074 - protein, 291 aa, Staphylococcus aureus; identical to SEQ ID NO: 30390
  subsp. aureus 21283

SEQ ID NO: 35075 - protein, 681 aa, Staphylococcus aureus; identical to SEQ ID NO: 32025
  subsp. aureus 21283

SEQ ID NO: 35076 - protein, 644 aa, Staphylococcus aureus; identical to SEQ ID NO: 31782
  subsp. aureus 21283

SEQ ID NO: 35077 - protein, 807 aa, Staphylococcus aureus; identical to SEQ ID NO: 30716
  subsp. aureus 21283

SEQ ID NO: 35078 - protein, 141 aa, Staphylococcus aureus; identical to SEQ ID NO: 30715
  subsp. aureus 21283

SEQ ID NO: 35079 - protein, 901 aa, Staphylococcus aureus
  subsp. aureus 21305
MGQEKEAAASEQNNTTVEESGSSATESKASETQTTTNNVNTIDETQSYSATSTEQPSQSTQVTTEEAPKTVQAPKVETSRVDLPSEKVADKETTGTQVDTAQPSNVSEIKPRVKRSTDVAVVAGEAKATGTDVTNKVTVENGSEIVGHKQDMNVVNPHNAERVTLKYKWKFGEGIKEGDYFDFTLSDNVETHGISTLRKVPEIKSSTEDKVMANGQVIDERKIRYTFTDYINSKKDLTAELNLNLFIDPTTVTKQGKQNVKVTLGNKEIEKEFDIKYLYGVKDRMGVTVNGRIHTLNKEEGRFSHFAYVKPNNQSLTSVTVSGQVTKGNKSGASNPSVKVYKHIGSDELAESVYAKLDDANKFEDVTNKVNLSYTGDGGYSLDFSDLDNSKDYVIKYEGEYDQNAKDLNFRTHLSGYHKNYPYYPNYYYPVQLTWNNGVAFYSNNAQGDGKDKPKEPIIEHSTPIELEFKSEPPVEKHELTGTIEESNDSKPIDFEYHTAVEGAEGHVEGIVETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENNHHISHSGLGTENGHSNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSVQNEGQQTIEEDTTPPTPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 35080 - protein, 992 aa, Staphylococcus aureus; identical to SEQ ID NO: 33872
  subsp. aureus 21305

SEQ ID NO: 35081 - protein, 233 aa, Staphylococcus aureus; identical to SEQ ID NO: 30428
  subsp. aureus 21305

SEQ ID NO: 35082 - protein, 231 aa, Staphylococcus aureus; identical to SEQ ID NO: 33623
  subsp. aureus 21305

SEQ ID NO: 35083 - protein, 2492 aa, Staphylococcus aureus
  subsp. aureus 21305
MNLFRQQKFSIRKFNVGIFSALIATVTFISINPTTASAAEQNQPAQNQPAQPADANAQPNANAGAQANPAAQPAAPANQGGQANPAGGTAQPAGGAAQPAAGTAQPAGQGNQADPNNAAQAQPGNQAAPANQAGQGNNQATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKSDQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQTDIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIETTMTAQDLERVKNEEISKIENITDSTQTKMDAYNEVKQAATARKAQNATVSNATNEEVAEADAAVEAAQKQGLHDIQVVKSKQEVADTKSKVLDKINAIQTQAKVKPAADTEVENAYNTRKQEIQNSNASTTEEKQAAYTELDTKKQEARTNLDTANSNSEVATAKDNGIAAINQVQAATTKKSDAKAEIAQKASERKTAIEAMNDSTTEEQQAAKDKVDQAVVTANADIDNAAANADVDNAKTTNEATIAAITPDANVKPAAKQAIADKVQAQETAINANNGSTTEEKEAAKQQVQTEKTTADTAIDGAHSNAEVEAAKNAEIAKIEAIQPATTTKDDAKQAIAMKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAAITNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKLNAKNDVDQAVTTQNQAIDNTTGATTEEKNAAKDLVLKAKEKAYLDILNAQTTNDVTQIKDQAVTDIQGITADTTIKDVAKDELATKANEQKALIAQTADATTEEKEQANQQVDAQLTQGNQNIENAQSIDDVNTAKENAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQTSVGPVANNKAKDMQTNDTQKSVGSVANNKATQNDGANASPATVSNGSNSANQDMLNVTKPEENKVKTKSAQQGKVNKPKQQAKTLPDTGMSHNDDLPYAELALGAGMAFLIRRFTKKDQQTEE

SEQ ID NO: 35084 - protein, 37 aa, Staphylococcus aureus
  subsp. aureus 21305
MKDGSFYNLDLRSKLKFKYMGEVIESKQIKDIEVNLK

SEQ ID NO: 35085 - protein, 157 aa, Staphylococcus aureus; identical to SEQ ID NO: 33841
  subsp. aureus 21305

SEQ ID NO: 35086 - protein, 232 aa, Staphylococcus aureus; identical to SEQ ID NO: 30584
  subsp. aureus 21305

SEQ ID NO: 35087 - protein, 232 aa, Staphylococcus aureus; identical to SEQ ID NO: 30583
  subsp. aureus 21305

SEQ ID NO: 35088 - protein, 231 aa, Staphylococcus aureus; identical to SEQ ID NO: 33378
  subsp. aureus 21305

SEQ ID NO: 35089 - protein, 234 aa, Staphylococcus aureus; identical to SEQ ID NO: 33390
  subsp. aureus 21305

SEQ ID NO: 35090 - protein, 158 aa, Staphylococcus aureus
  subsp. aureus 21305
MNVVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 35091 - protein, 356 aa, Staphylococcus aureus; identical to SEQ ID NO: 33847
  subsp. aureus 21305

SEQ ID NO: 35092 - protein, 231 aa, Staphylococcus aureus; identical to SEQ ID NO: 30768
  subsp. aureus 21305

SEQ ID NO: 35093 - protein, 226 aa, Staphylococcus aureus; identical to SEQ ID NO: 33849
  subsp. aureus 21305

SEQ ID NO: 35094 - protein, 203 aa, Staphylococcus aureus; identical to SEQ ID NO: 30346
  subsp. aureus 21305

SEQ ID NO: 35095 - protein, 691 aa, Staphylococcus aureus; identical to SEQ ID NO: 33852
  subsp. aureus 21305

SEQ ID NO: 35096 - protein, 808 aa, Staphylococcus aureus
  subsp. aureus 21305
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPVKKLEELKTNFSKSAPQKNTNLNWWDYEIGTPRALTNTLILLKEDFTDEEKKKYTAPIKTFAPKSDEILSSVGKAEPAKGGNLVDIAKVKLLESIIEEDKDMTKNSIDAFNKVFTYVQSNASGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDESTKAKYKKIVKSSVESDSSYKQNDYLNSYSDIDKMKSLMDDSTISTNGLTQQLKIYNDMDRVTYHNKDLDFAFGLSMTSKNVARYESINGENLKGWHTGAGMSYLYNSDVKHYRDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQGTNSVFLESTDTKKNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFVLKKKDDNTYECSFYNPESTNSTSDIESKISMTGYSITNKNTSTSNESGVRFELTK

SEQ ID NO: 35097 - protein, 247 aa, Staphylococcus aureus; identical to SEQ ID NO: 33631
  subsp. aureus 21305

SEQ ID NO: 35098 - protein, 141 aa, Staphylococcus aureus; identical to SEQ ID NO: 30524
  subsp. aureus 21305

SEQ ID NO: 35099 - protein, 319 aa, Staphylococcus aureus
  subsp. aureus 21305
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGTNVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKASKQQTNIDVIYERVRDDYQLHWTSTNWKGTNTKDKWTDRSSERYKIDWEKEEMTN

SEQ ID NO: 35100 - protein, 165 aa, Staphylococcus aureus; identical to SEQ ID NO: 31315
  subsp. aureus 21305

SEQ ID NO: 35101 - protein, 109 aa, Staphylococcus aureus; identical to SEQ ID NO: 30603
  subsp. aureus 21305

SEQ ID NO: 35102 - protein, 350 aa, Staphylococcus aureus
  subsp. aureus 21305
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKIEKVKPTVTTTSKVEDNHSTKVVSTETTKDQTKTQTAHTVKTAQTAQEQNKVQTPVKDVATAKSESNNQAVSDNKSQQTNKVTKQNETPKQASKAKELPKTGLTSVDNFISTVAFATLALLGSLSLLLFKRKESK

SEQ ID NO: 35103 - protein, 641 aa, Staphylococcus aureus; identical to SEQ ID NO: 33886
  subsp. aureus 21305

SEQ ID NO: 35104 - protein, 62 aa, Staphylococcus aureus
  subsp. aureus 21305
MPPNSPKNGTNASNKNEAKDSKEPLPDTGSEDEANTSLIWGLLASLGSLLLFRRKKENKDKK

SEQ ID NO: 35105 - protein, 331 aa, Staphylococcus aureus
  subsp. aureus 21305
MSNQFKSEEERRQWEQFQAFQNQQNQQHQQYGQKKSKKGWFLGCGGCLVLFILIIIGISACTAGVTGNLGGNSSKEANKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETATVEPMPHSKPTTSEAPPSQNIHNEDSMYDASTE

SEQ ID NO: 35106 - protein, 2186 aa, Staphylococcus aureus
  subsp. aureus 21305
MNLLKKNKYSIRKYKIGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVASNNTTLNVPNKTNENGSGGHLTLKEIQEDVRHSSDKPELVAIAEPASNRPKKRSRRAAPADPNATPADPGAAAAGNGGAPVAITAPYTPTTDPNANNAGQNAPNEVLSFDDNSIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNADTNDTIAEKTVEGGPTLRLFKVPDNVRNLKIQFVPKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDSLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNVDVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKSREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNEEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHNEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKVIQPAPKVCTPIKKEETHESRKVEKELPNTGSEGMDLPLKEFALITGAALLARRRTKNEKES

SEQ ID NO: 35107 - protein, 858 aa, Staphylococcus aureus
  subsp. aureus 21305
MINRDNKKAITKKGMISNRLNKFSIRKYTVGTASILVGTTLIFGLGNQEAKAAENTSTENAKQDDATTSDNKEVVSEAENNSTTENDSTNPIKKETNTDSQPEAKEESTKSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSAAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDAKGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQN

SEQ ID NO: 35108 - protein, 79 aa, Staphylococcus aureus
  subsp. aureus 21305
DSDSDSDSDSDSDSDSDSDAGKHTPVKPMSTTKDHHNKAKALPETGNENSGSNNATLFGGLFAALGSLLLFGRRKKQNK

SEQ ID NO: 35109 - protein, 895 aa, Staphylococcus aureus
  subsp. aureus 21305
MNKHHPKLRSFYSIRKSTLGVASVIVSTLFLITSQHQAQAAENTNTSDKISENQNNNATTTQPPKDTNQTQPATQPANTTKTYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSMINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRKLIFPYIPDKAVYNAIVKVVVANIGYEGQYHVRIINQDINTKDDDTSQNNTSEPLNVQTGQEDKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKITEHLPSDIHKTVDKTVKTKEKAGTPSKENKLSQSKMLPKTGETTSSQSWWGLYALLGMLALFIPKFRKESK

SEQ ID NO: 35110 - protein, 452 aa, Staphylococcus aureus
  subsp. aureus 21305
MKKKNIYSIRKLGVGIASVTLGTLLISGGVTPAANAAQHDEAQQNAFYQVLNMPNLNADQRNGFIQSLKDDPSQSANVLGEAQKLNESQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGQEDGNKPGKEDGNGVHVVKPGDTVNDIAKANGTTADKIAADNKLADKNMIKPGQELVVDKKQPANHADANKAQALPETGEENPFIDTTVFGGLSLALGAALLAGRRREL

SEQ ID NO: 35111 - protein, 241 aa, Staphylococcus aureus
  subsp. aureus 21305
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVCKPHAVRDMNGHALPLTKDGNFYQTNVDANGINHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 35112 - protein, 241 aa, Staphylococcus aureus; identical to SEQ ID NO: 31311
  subsp. aureus 21305

SEQ ID NO: 35113 - protein, 241 aa, Staphylococcus aureus; identical to SEQ ID NO: 33879
  subsp. aureus 21305

SEQ ID NO: 35114 - protein, 238 aa, Staphylococcus aureus
  subsp. aureus 21305
MCKNITKNIILTTTLLLLGTVLPQNQKPVFSFYSEAKAYSIGQDETNINELIKYYTQPHFSFSNKWLYQYDNGNIYVELKRYSWSAHISLWSAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 35115 - protein, 240 aa, Staphylococcus aureus
  subsp. aureus 21305
MKKRLLFVIVITLFIFSSNHTVLSNGDVGTGNLRNFYTKYEYVNLKNVKDKNSPESHRLEYSYKNDTLYAEFDNEYITSDLKEKNVDVFGISYKYGSNSRTIYGGVTKAENNKLDSPRIIPINLIINGKHQTVTTKSVSTDKKMVTAQEIDVKLRKYLQDEFNIYGHNDTGKGKEYGTSSKFYSGFDKGSVVFHMNDGSNFSYDLFYTGYGLPESFLKIYKDNKTVGSTQFHLDVEISKR

SEQ ID NO: 35116 - protein, 266 aa, Staphylococcus aureus; identical to SEQ ID NO: 30426
  subsp. aureus 21305

SEQ ID NO: 35117 - protein, 434 aa, Staphylococcus aureus [sequence omitted]

SEQ ID NO: 35118 - protein, 321 aa, Staphylococcus aureus; identical to SEQ ID NO: 30959
  subsp. aureus 21305

SEQ ID NO: 35119 - protein, 315 aa, Staphylococcus aureus; identical to SEQ ID NO: 30573
  subsp. aureus 21305

SEQ ID NO: 35120 - protein, 236 aa, Staphylococcus aureus
  subsp. aureus 21305
MKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 35121 - protein, 1046 aa, Staphylococcus aureus
  subsp. aureus 21305
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRIAAVQPSSTEAKNVNDLITSNTTLTVVDADKNNKIVPAQDYLELKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLHKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKNKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLN

SEQ ID NO: 35122 - protein, 973 aa, Staphylococcus aureus
  subsp. aureus 21305
MNNKKTVTNRKGIIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPSQTQNLYNAQGNIIAKGIYDSKTNTTTYTFTNYVDQYTNVSGSIEQVAFAKRENATTDKTAYKMEVTLGNDKYSKDVIVDYGNKKAQPLISSTNYINNEDLSRNMTAYVNQPKNTYTKQTFVTNLTGYKFNPNAKNFKIYEVTDQNQFVDSFTPDTSKLKDVTNQFNITYSNDNKTATVDLMNGQTSSNKQYIIQQVAYPDNTSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSESDADSDTDSDSDAGKHTPAKPMSTVKDQHKTAKALPETGSENNNSNNGTLFGGLFAALGSLLLFGRRKKQNK

SEQ ID NO: 35123 - protein, 51 aa, Staphylococcus aureus; identical to SEQ ID NO: 32222
  subsp. aureus 21305

SEQ ID NO: 35124 - protein, 638 aa, Staphylococcus aureus
  subsp. aureus 21305
MKKRIDYLSNKQNKYSIRRFTVGTTSVIVGATILFGIGNHQAQASEQSNDTTQSSKNNASADSEKNNMIETPQLNTTANDTSDISANTISANVDSTAKPMSTQTSNTTTTEPASTNETPQPTAIKDQATAAKMQDQTVPQEANSQVDNKTTNDANSIATNSELKNPQTLDLLQSSPQTISNAQGTSKPSVRTRAVRSLAVAEPVVNAADAKGTNVNDKVTASNLQLQKTTFDPNQSGNTFMAVNFKVAGKVKSGDYFTAKLPDSVTGNGDVDYSNSNNTMPIADIKSTNGDVVAKATYDILTKTYTFVFTDYVNEKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPEPTPDPEPSPDPEPEPTPDPEPSPDPDPDSDSDSDSDSDSDSESDSDSDSDSESDSDSDSDSDSDSDSDNDSEFRQ

SEQ ID NO: 35125 - protein, 2275 aa, Staphylococcus aureus
  subsp. aureus 21305
MSKRQKVFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESISSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDKSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSESSSTSQSLSDSTSNAISTSESLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSILTSFSDSTSDSKSASTASSESISQSASTSTSGSVSTSTSLSTSNSERTSTSMSDSTSLSTSESDSISESTSTSDSISEAISASESTSISLSESNSTSDSESQSASAFLSESLSESISESTSESVSSSTSASTSLSDSTSESGSTSTSLSNSTSGSASISTSTSNSESTSTFKSESVSTSLSTSTSTSLSDSTSLSTSISDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSMSRSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSESTSESGSTSESTSESDSTSTSLSDSQSTSRSTSASGSASTSTSTSDSRSTSASTSTSMRTSTLDSQSMSPSTSTSTSVSDSTSLSDSVSDSTSDSTSMSISDSMSVSVSLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISVSTSLSDSSSTSTSESLSDSMSQSQSTSTSASGSLSTSISTSMSMSASTSTSQSTSVSTSLSTSDSISDSTSISIRGSQSTVESESTSDSTSISDSESLSTSGSDSTSTSTSDSTSGSTSTSTSESLSTSGSGSTSVSDSTSMSESDSTSDSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTSAQSEKRLPDTGDSIKQNGLLGGVMTLLVGLGLMKRKKKKDENDQDDSQA

SEQ ID NO: 35126 - protein, 681 aa, Staphylococcus aureus
  subsp. aureus 21305
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRLDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 35127 - protein, 146 aa, Staphylococcus aureus
  subsp. aureus 21305
SDSDSESDSDSESDSESDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 35128 - protein, 577 aa, Staphylococcus aureus
  subsp. aureus 21305
MKFKSLITTTLALGVIASTGANFNTNEASAAAKPLDKSSSTLHHGHSNIQIPYTITVNGTSQNILSSLTFNKNQNISYKDIENKVKSVLYFNRGISDIDLRLSKQAEYTVHFKNGTKRVIDLKSGIYTADLINTSDIKAISVNVDTKKQPKDKAKANVQVPYTITVNGTSQNILSNLTFNKNQNISYKDLEGKVKSVLESNRGITDVDLRLSKQAKYTVNFKNGTKKVIDLKAGIYTANLINSSDIKSININLDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKINKSNNVKFPVTINKFENIVSNEFVFYNASKITINDLSIKLKSAIANDQGITKHDIELAERAVYKVYFKNGSSKYVDLKTEYKDERVFKATDIKKVDIELKF

SEQ ID NO: 35129 - protein, 274 aa, Staphylococcus aureus; identical to SEQ ID NO: 30872
  subsp. aureus 21305

SEQ ID NO: 35130 - protein, 338 aa, Staphylococcus aureus; identical to SEQ ID NO: 31292
  subsp. aureus 21305

SEQ ID NO: 35131 - protein, 350 aa, Staphylococcus aureus; identical to SEQ ID NO: 34016
  subsp. aureus 21305

SEQ ID NO: 35132 - protein, 327 aa, Staphylococcus aureus; identical to SEQ ID NO: 30616
  subsp. aureus 21305

SEQ ID NO: 35133 - protein, 311 aa, Staphylococcus aureus; identical to SEQ ID NO: 30617
  subsp. aureus 21305

SEQ ID NO: 35134 - protein, 258 aa, Staphylococcus aureus
  subsp. aureus 21305
MKKLSTVIIILILEIVFHNMNYVNAQPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFSKKELVPFVPYKFLNIYGDNKVVDSKSIKMEVFLNTH

SEQ ID NO: 35135 - protein, 251 aa, Staphylococcus aureus; identical to SEQ ID NO: 33835
  subsp. aureus 21305

SEQ ID NO: 35136 - protein, 238 aa, Staphylococcus aureus; identical to SEQ ID NO: 33836
  subsp. aureus 21305

SEQ ID NO: 35137 - protein, 242 aa, Staphylococcus aureus; identical to SEQ ID NO: 30399
  subsp. aureus 21305

SEQ ID NO: 35138 - protein, 239 aa, Staphylococcus aureus; identical to SEQ ID NO: 30622
  subsp. aureus 21305

SEQ ID NO: 35139 - protein, 254 aa, Staphylococcus aureus; identical to SEQ ID NO: 33839
  subsp. aureus 21305

SEQ ID NO: 35140 - protein, 270 aa, Staphylococcus aureus
  subsp. aureus 21305
MIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 35141 - protein, 700 aa, Staphylococcus aureus
  subsp. aureus 21305
MNYRDKIQKFSIRKYTVGTFSTVIATLVFLGFNTSQAHAAETNQPESVVKQKQQSNNEQTENRESQVQNSQNSQNGQSLSATHENEQPNISQANLVDQKVAQSSTTNDEQPASQNVNTKKDSATAATTQPDKEQSKHKQNESQSANKNGNDNRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSIESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPHRSHDFKIRNRSGQVIYDWPTVHIYSLEDLSRASGYFSEAGATPATKAFGRQNFEYINGQKPAESPGVPKVYTFIGQGDASYTISFKTQGSTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYSNNANTNAFRPGGAQQLNEYQLSQLFTDQKLQEAARTRNPIRLMIGFDYPDAYGNSETLVPVNLTVLPEIQHNIKFFKNDDTQNIAEKPFSKQAGHPVF

SEQ ID NO: 35142 - protein, 325 aa, Staphylococcus aureus; identical to SEQ ID NO: 30484
  subsp. aureus 21305

SEQ ID NO: 35143 - protein, 312 aa, Staphylococcus aureus; identical to SEQ ID NO: 30391
  subsp. aureus 21305

SEQ ID NO: 35144 - protein, 250 aa, Staphylococcus aureus; identical to SEQ ID NO: 33827
  subsp. aureus 21305

SEQ ID NO: 35145 - protein, 676 aa, Staphylococcus aureus
  subsp. aureus 21305
MNMKKKEKHAIRKKSIGVASVLVGTLIGFGLLSSKEADASENSVTQSDSASNESKSNDSSSINAAPKTDNTNMSDTKPTSNTNNGETSVAQNPAQQETTQSASTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRKRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSGSDSNSDSGSDSASDSDSASDSDSASDSDSASDSDSASDSDSASDSDSASDSDSASDSDSASDSDSASDSDSASDSDSDSDSDSDSDSYSDSDSDSDSDSDSD

SEQ ID NO: 35146 - protein, 226 aa, Staphylococcus aureus; identical to SEQ ID NO: 33865
  subsp. aureus 21305

SEQ ID NO: 35147 - protein, 372 aa, Staphylococcus aureus
  subsp. aureus 21310
MNKQQSKVRYSIRKVSIGILSISIGMFLALGMSNKAYADEIDKSKDFTRGYEQNVFAKSELNANKNTTKDKIKNEGVVKTSDTSLKLDNKSAISNGNEINQDIKISNTPKNSSQGNNLVVNNNEPTKEIKIANLEAQNSNQKKTNKVTNNYFGYYSFREAPKTQIYTVKKGDTLSAIALKYKTTVSNIQNTNNIANPNLIFIGQKLKVPMTPLVEPKPNTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKSEVAHKVVHNYENDMIFIRPFKKA

SEQ ID NO: 35148 - protein, 241 aa, Staphylococcus aureus
  subsp. aureus 21310
MKKNIMNKLVLSTALLLLGTTSTQLPKTPISFSSEAKAYNISENETNINELIKYYTQPHFSLSGKWLWQKPNGSIHATLQTWVWYSHIQVFGAESWGNINQLRDKYVDIFGTKDEDTVEGYWTYDETFTGGVTPAATSSDKSYKLFLKYSDKQQTIIGGLEFYKGNKPVLTLKELDFRIRQTLINNKKLYNGEFNKGQIKITGGGNNYTIDLSKKLKLTDTNRYVKNPRHAEIEVILEKSN

SEQ ID NO: 35149 - protein, 241 aa, Staphylococcus aureus
  subsp. aureus 21310
MKKNITKKIILSSALLLLGAVSTQLPNTPISSKSEAKAYYINQEETNVSELIKYYTQQHLTFSNKWLWQKDNGTIHATLLQISWYSHIQVFGPESWGNINQLRDKYVDIFGIKDQETIDSYALSQETFTGGVTPAAKPNDKHYKLNVTYKDKDETFIGGYPFYTGNKPVLTLKEVDFRIRQTLIKNKKLYQDKYNKGQLTITGDDNNYTIDLSKRLPSTDANKYVKNPQNAKIEVTLEKSN

SEQ ID NO: 35150 - protein, 238 aa, Staphylococcus aureus
  subsp. aureus 21310
MKKNITNKIILTATLLILGTSSAQLPNTPIGFSSEAKAYHIGQDETNINELIKYYTQKPLTFSNRWLYQYDDGNIYVEFKRYSWSAHIRLWGAESWGNINQLRDRYVDVFGLKDKDTRRLWWVYTDTFTGGVTPAASSSDKPYNIYVQYKDKLQTFIGAHKIYQGNKPVLTLKEIDFRVRESLIKNKILYNENRNKGNIHITGGGNNFTIDLSKRLHSDLANVYVKNPQKITVEVLID

SEQ ID NO: 35151 - protein, 319 aa, Staphylococcus aureus
  subsp. aureus 21310
MKTRIVSSVTTTLLLGSILMNPVANAADSDINIKTGTTDIGSNTIVKTGDLVTYDKENGMHKKVFYSFIDDKNHNKKILVIRTKGTIAGQYRVYSEEGANKSGLAWPSAFKVQLQLPDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKATKQQSNIDVIYERVRDDYQLHWTSTNWKGTNTKDKWTDRSSERYKIDWEKEEMTN

SEQ ID NO: 35152 - protein, 125 aa, Staphylococcus aureus
  subsp. aureus 21310
MSINHNIVEYNDGTFKYQSRPKFNSTPKYIKFRHDYNIVEYNDGTFGYGPRPHFNKPAAKTDATIKKEQKLIQAQNLVREFEKTHTVSAHRKAQKAVNLVSFEYNVKKMILQERIDEVLKQGLVR

SEQ ID NO: 35153 - protein, 91 aa, Staphylococcus aureus; identical to SEQ ID NO: 33329
  subsp. aureus 21310

SEQ ID NO: 35154 - protein, 1004 aa, Staphylococcus aureus
  subsp. aureus 21310
MINRDNKKAITKKGMISNRLNKFSIRKYTVGTASILVGTTLIFGLGNQEAKAAENTSTENAKQDDATTSDNKEVVSEAENNSTTENDSTNPIKKETNTDSQPEAKEESTTSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDS

SEQ ID NO: 35155 - protein, 871 aa, Staphylococcus aureus
  subsp. aureus 21310
MNNKKTATNRKGMIPNRLNKFSIRKYSVGTASILVGTTLIFGLSGHEAKAAEHTNGELNQSKNETTGTSENKTTEKVDSRQLKDNTQTATADQPKVTMSDSATVKETSSNMQSPQNATANQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPAQNQNLYNAQGNIIAKGIYDSKTNTTTYTFTNYVDQYTNVSGSFEQVSFAKRENATTDKTAYKMEVTLGNDKYSKDVIVDYGNKKGQQLISSTNYINNEDLSRNMTVYVNQPKNKYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSYSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 35156 - protein, 2438 aa, Staphylococcus aureus
  subsp. aureus 21310
MNLFRQQKFSIRKFNVGIFSALIATVTFISINPTTASAAEQNQPAQNQPAQPADPNAQPNANAGAQANPTAQPAAPANQGGQADPAANQGGQANPAGGAVQPAAGTTQPAGQGNQADPNNAAQAQPGNQAAPANQAGQGNNQATPNNNATPANQTQPANAPAGAQPAAAVAANGQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNIANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKITAAQQSKKVTQDEVAALVTKINNDKNNAIAEINKQTTAQGVTTEKDNGIAVLEQDVITPTVKPQAKQDIIQAVTTRKQQIKKSTASLQDEKDVANDKIGKIETKAIKDIDAATTNAQVEAIKTKAINDINQTAPATTAKAEALEEFDEVVQAQIDQAPLNPDTTNEEVAEAIERINAAKVSGVKAIEATTTAQDLERVKNEEIFKIENITDSTQTKMDAYKEVKQAATARKAQNATVSNATDEEVAEANAAVDAAQTEGLHDIQVVKSQQEVADTKAKVLDKINAIQTQSRVKPAADTEVDNAYNTRKQEIQNSNASTTEEKEAAYTELDAKKQEARTNLDAANTNSAVTTAKDNGIAAINQVQAATTKKSDAKAEIAQKASERKTAIEAMNDSTSEEQQAAKDKVDQAVVTANADIDNAAANSDVDNAKTTNEATIAAITPDANVKPQAKQAIADKVQAQETAIDANNGATTEEKAAAKQQVQTEKTTADTAIDGAHSNAEVEAAKNAEIAKIEAIQPATTTKDNAKQAIATKANERKTAIAQTQDITAEEIAAANADVDNAVIQANSNIEAANSQNDVDQAKTTGETSIDQVTPTVNKKATARNEITTTLNNKLQEIQATPDATDEEKQDAETEANTENAKANQAITAATTNAEVDEAKTNAEAAINAVTPKVMKKQAAKDEIDQLQAAQTAVINNDQNATNEEKEAAIQQLATAVTDAKNNITAATDNNGVDTAKDAGKNSIQSTQPATAVKSNAKNDVDQAVTTQNQAIDNTTGATTEEKNAAKDLVSKAKEKAYQDILNAQTTNDVTQLKDQAVADIQGITADTTIKDVAKGELTAKANEQKALIAQTADATTEEKEQANQQVDAQLTQGNQNIENAQSIDDVNTAKDNAVQAIDPIQASTDVKTNARAELLNEMQNKITEILNDNTTTNEEKGKDIGPVRAAYEEGLNNINVANSTGDVTTAKDAAVQKVQQLHANPVKKPAGKTELDQAAADKKTQIEQTPNASQQEINDAKQEVDTELNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNSDVDDALTQGKATIDAVQVDATVKAKANQAIDAKAQETKESIDQSDQLTAEEKTEALATIKQITDQAKQGITDATTTAEVEKAKAQGLEAFDNIQIDSTEKQKAIEELETALDQIEAGVNVDSDATTEEKEVFTNALEEILSKATEDISDQTTNAEIATVKNSALEQLKAQRINPEVKKNALEAIREVVNKQIEIIKNADADASAKEIARTDLGRYFDRFADDLDKTQTNAEVAELQNVTIPAIEAIVPQNDPDANHSSSDNNDATANTNVNAEPDNAGQPNVTESTDNANADTSSTTTNNHNDAATGETTATSTNNSSTDDANDKPTANNNSSVDASIDNSATGNGTTDKPATTESTEKTSSADSKDNASVNDSNQNAEVNNSAESQPTNGKVAQPKSENKAKVEKDGRDSTNQSMVESTTETLPSADITEPNVPSNTSKDKEESTSNQTDAGQLKSETNVASNEADKSPSKADTEVSNKPSTSASSEAKDKMTSTEDSQKADMATADTKDNQASIGSSADANNKATQNDGANASPATVSNGSNSANQDMLNVTKPEENKANAKSDQQGKVNKPKQQAKTLPDTGMSHNDDLPYAELALGAGMAFLIRRFTKKDQQTEE

SEQ ID NO: 35157 - protein, 274 aa, Staphylococcus aureus; identical to SEQ ID NO: 30872
  subsp. aureus 21310

SEQ ID NO: 35158 - protein, 338 aa, Staphylococcus aureus
  subsp. aureus 21310
MIKQLYKNITICTLALSTTFTVLPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAYLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHNVKFVKVLNDNEKK

SEQ ID NO: 35159 - protein, 350 aa, Staphylococcus aureus
  subsp. aureus 21310
MKNKKRVLIASSLSCAILLLSAATTQANSAHKDSQDQNKKEHVDKSQQKEKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKEGQRLIVTYEVDWKNKTVKVVDKYSDNKSFREG

SEQ ID NO: 35160 - protein, 434 aa, Staphylococcus aureus [sequence omitted]

SEQ ID NO: 35161 - protein, 937 aa, Staphylococcus aureus
  subsp. aureus 21310
MNMKKKEKHAIRKKSIGVASVLVGTLIGFGLLSSKEADASENSVTQSDSASNESKSNDSSSVSAAPKTVDTNVSDTKTTSNTNSGETSVAQNPAQQETTQSASTNATTEETPATGEATTTATNQANTPATTQSSNTNAEELVNQTNNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSESDSDSDSGSNNNVVPPNSPKNGTNASNKNEAKDSKEPLPDTGSEDEANTSLIWGLLASLGSLLLFRRKKENKDKK

SEQ ID NO: 35162 - protein, 670 aa, Staphylococcus aureus
  subsp. aureus 21310
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTTFDPNQSGNTFMAANFTVTDKVKSGDYFTAKLPDSLTGNGDVDYSNSNNTMPIADIKSTNGDVVATATYNILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPVDPTPGPPVDPEPSPEPEPEPTPDPEPSPDPEPEPTPDPEPSPDPEPEPTPDPEPSPDPDSDSDSDSDSDSNSDLDSDSGSDSDSDSDSDSDSDSDSDLDSDSDSDSDSDSDSDSDSDSDSDSDSDS

SEQ ID NO: 35163 - protein, 1373 aa, Staphylococcus aureus
  subsp. aureus 21310
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTSSKNTTSSSDTKSVASTSSTEQQTNISTNQSTASNTTSQSTAPASTHLKQTSTTSTSTAPVKLRTFSRLAMSTFASAATTTALTANTITVNKDNLKQYMTTSGNATYDQSTGVVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSSVAGGGAFGAFVTTDSTGVATTYTSSSTADNAAKLKVQPTNNTFQNFDITYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDKSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLFKSQSLSTSTSDSASTSQSVSDSTSNSISTSESLSESVSTSESISISNSISNSVSASTSKSESQSTSISLSTSDSKSMSTSESLSDSTSTSDSVSGSLSVAGSQSVSTSTSDSMSTSEMISDSMSTSGSLAASDSKSMSVSSSMSTSQSVSTSESLSDSISTSDSDSKSLSLSTSQSGSTSTSTSTSASVRMSESQSMSGSMSASQSDSTSISTSFSDSTSDSKSASTASSESVSQSVSTSTSGSVSTSTSLSTSSSERTSTSLSASTSLSTSESGSTSDSTSTSDSISEAISGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 35164 - protein, 681 aa, Staphylococcus aureus
  subsp. aureus 21310
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSRNNKNIQRDTTKNNNANPSDVNQGLEQAINDGKQSKVASQQQSKEADNSQDSNANNNLPSQSRTKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 35165 - protein, 1183 aa, Staphylococcus aureus
  subsp. aureus 21310
MNKNVLKFMVFIMLLNIITPLFNKNDAFAARDISSTNVTDLTVSPSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKAIEKTKDVSAQKVWEGSQKVKPTIYFKLYKQDDNQNTTPVDKAEIKKLEDGTTKVTWSNLPENDKNGKAIKYLVKEVNAQGEDTTPEGYTKKENGLVVTNTEKPIETTSISGEKVWDDKDNQDGKRPEKVSVNLLANGEKVKTVDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPETTSISGEKVWDDKDNQDGKRPEKVSVNLLANGEKVETVDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPETTSISGEKVWDDKDNQDGKRPEKVSINLLANGEKVKTVDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWSHTWTGLDEKAKGQQVKYTVEELTKVKGYTTHVDNNDIGNLIVTNKYTPEKPNKPIYPEKPKDKTPPTKPDHSNKVKPTPPDKPSKVDKADQSKDNKTKPENPLKELPKTGMKIITSWITWVFIGILGLYLILRKRFNS

SEQ ID NO: 35166 - protein, 644 aa, Staphylococcus aureus
  subsp. aureus 21310
MNKQQKEFKSFYSIRKSSLGVASVAISTLLLLMSNGEAQAAEETGGTNTEAQPKTEALASPTTTTEKAPETKPVANAVSVSNKEVEAPTSETKEAKEVKEVKAPKETKAVKPAAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAINNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPAKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 35167 - protein, 350 aa, Staphylococcus aureus
  subsp. aureus 21310
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQSQTQSARTVKTTQTAQEQNKVQTPVKDVATAKSESNSQAVSDNKSQQTNKVTKQNETPKQASKAKELPKTGLTSVDNFISTVAFATLALLGSLSLLLFKRKESK

SEQ ID NO: 35168 - protein, 109 aa, Staphylococcus aureus; identical to SEQ ID NO: 33345
  subsp. aureus 21310

SEQ ID NO: 35169 - protein, 478 aa, Staphylococcus aureus
  subsp. aureus 21310
MRDKKGPVNKRVDFLSNKLNKYSIRKFTVGTASILIGSLMYLGTQQEAEAAENNIENPTTLKDNVQSKEVKIEEVTNKDTAPQGVEAKSEVISNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVG

SEQ ID NO: 35170 - protein, 934 aa, Staphylococcus aureus
  subsp. aureus 21310
MIVVGMGQEKEAAASEQNNTTVEESGSSATERKASETQTTTNNVNTIDETQSYSATSTEQPSQSTQVTTEEAPTTVQAPKVETSRVDLPSEKVADKETTGTQVDTAQPSNVSEIKPRMKRSTDVTAVTEKEVVEEAKATGTDVTSKVEVEEGSEIVGHNNKETNVVNPHNAERVTLKYKWKFEDGIKPGDYFDFTLSNNVETHGISPLRKVPDIKSKDDNILAVGKVMDERKIRYTFTDYINNKNNLMAELNLNLFIDPTTVTKQGKQTVEVKLGENKISKEFDIKYLDGVKDNWGVTVNGRITLLDKENSKIHHLAYINPKKSDMTSITINGFFAKGGLYTGNVPTVKVYEYLRSDELPESVYANTNDQEKFKDVTNDMSDKLTLSENGSYKLTLDALNKKSYVVSFEGKYNENDKELLFRTNLHGYHANYGYYYYYPVSLTWDNGVAFYSNNAQGDGKDKPNDPIIEKSEPIELDIKSEPPVEKHELTGTIEESNDSKPIDFEYHTAVEGVEGHAEGIIETEEDSIHVDFEESTHENSKHHADVVEYEEDTNPGGGQVITESNLVEFDEESTKGILTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNSVEYEEDTLPQVSGHNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGILFGGLFSILGFALLRRNKKNHKA

SEQ ID NO: 35171 - protein, 992 aa, Staphylococcus aureus
  subsp. aureus 21310
MIVVGMGQDKEAAASEQKTTTVEENGNSATENKVNETQTTTTNVNTIDETQSYSATATEQPSNATQVTTEEAPKAVQAPQTAQPANLETVKEEVVKEEAKPQVKETTQSQDNSGDQRQVDLTPKKATQNQVAETQVEVAQPRTASESKPRVTRSADVVEAKEASDEKVETGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQNNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHTEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 35172 - protein, 682 aa, Staphylococcus aureus
  subsp. aureus 21310
MKFKSLITTTLALGVLASTGANFNTNEASAAAKPLDKSSSTLHHGHSKIQVPYTITVNGTSQNILSSLTFNKNQQISYKDLENKVKSVLYFNRGISDIDLRLSKQAEYTVHFKNGTKKVVDLKSGIYTADLINTSDIKAISVNVDTKKQPKDKAKANVQVPYTITVNGTSQNILSSLTFNKNQNVSYKDLEDKVKSVLESNRGITDVDLRLSKQAKFTVNFKNGTKKVIDLKAGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRVVHFNSKTYSANLVHAKDVKKIEVTVKTASKAKAERYVPYSIAVNGTSTPNLSDLKFTGDPRVGYKDITKKVKSVLKHDRGIGERELKYAKKATYTVHFKNGKKKVINLNSKISQLNLLYVQDIKKIDIDVKTGSKAKADSYVPYTIAVNGTSTHILSKLKISNKQLIGYQDLNEKVKSVLKHDRGINDIELKFAKQAKYTIHFKNGKTQVVDLKSDIFTRNLFSAKDIKKIDIDVKQHTKSKKINKSNNVKFPVTINKFENIVSNEFVFYNASKITINDLSTKLKSAMANDQGITKHDIGLAERAVYKVYFKNGSSKYVDLKTEYKDRKVFKATDIKKVDIELKF

SEQ ID NO: 35173 - protein, 128 aa, Staphylococcus aureus
  subsp. aureus 21310
SDSDSDSDSDSDSDSDSDSDSDSDSDSDSDSDSDSDSDSDSDSDSDSDSDSDSDSRVTPPNNEQKAPSNPKGEVNHSNKASKQHKTDDLPETGDKSENTNATLFGAMMALLGSLLLFRKRKQDHKEKA

SEQ ID NO: 35174 - protein, 233 aa, Staphylococcus aureus; identical to SEQ ID NO: 33414
  subsp. aureus 21310

SEQ ID NO: 35175 - protein, 211 aa, Staphylococcus aureus; identical to SEQ ID NO: 34056
  subsp. aureus 21310

SEQ ID NO: 35176 - protein, 331 aa, Staphylococcus aureus
  subsp. aureus 21310
MSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGTFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSEAKKTSKAKKDKQDTEVAVASSNSDNISYEASATTPATTSSADTDSEDSEKSSKDEDKQNASKSDKSSVEKSESNEETAPVEPMRQSKPTTSEAPPSQNIHNEDSMYDASTE

SEQ ID NO: 35177 - protein, 231 aa, Staphylococcus aureus; identical to SEQ ID NO: 33433
  subsp. aureus 21310

SEQ ID NO: 35178 - protein, 228 aa, Staphylococcus aureus
  subsp. aureus 21310
MKLKNIAKASLALGILTTGMITTTAQPVKASTLEVRSQATQDLKDYYKGQSFDLKNIGGYKEGNKVTFIYHNQQIDVTLTGNEKLEFNDDGEISNVDVFVVRENSDRSGITSSNGGITTSNKQDIIDNVKSVNMQITKKTSSNTETVTSSYYSISKENISLKELDFKLRKHLIDKNGLYKTEPKNSKIRVTMEDGGFYTFELNKKLQTNRMGDVIDATKIKEINVELN

SEQ ID NO: 35179 - protein, 227 aa, Staphylococcus aureus
  subsp. aureus 21310
MKLTALAKATLALGILTTGTLTTEAYSGHAKQNQKSVNKHDKEALHRYYSGNFKEMKNINALRHGKNNLRFKYRGMKTQVLLPGDEYRKYQQRRHTGLDVFFVQEKRDKHDISYTVGGVTKSNKTPGFVSAPLLNVTKENGEDAFVKGYPYDIKKEEISLKELDFKLRKHLIEKYGLYKTKSKDGKIKINLKDGSFYNLDLRSKLKFKHMGEVIDSKQIKDIEVNLK

SEQ ID NO: 35180 - protein, 232 aa, Staphylococcus aureus
  subsp. aureus 21310
MKLTALAKATLALGILTTGVFTAESKAVHAKVELDETQRKYYIYMLKDYYSEESYEPTNISVKSEDYYGSNVLNFNHRNKNFKVFLLGDDKNKYKEKTHGLDVFAVPELIDTKGGIYSVGGITKKNVRPVFGFVSHPGLLVKKIDPKHGFSVNELFFIQKEEVSLKELDFKIRKMLVEKYRLYKGASDKGRIVINMKDEKKYVIDLSEKLSFDRMFDVMDSKQIKNIEVNLN

SEQ ID NO: 35181 - protein, 231 aa, Staphylococcus aureus
  subsp. aureus 21310
MKLKTLAKATLALGLLTTGVITSEGQAVKAAEKQERVQHLHDIRDLHRYYSAPSFEYSNISGKVENYNGSNVVRFNQKDQNHQLFLLGKDKEEYKEGLQGQNVFVVQELIDPNGRLSTVGGVTKNNNKTSETKTQLVVNKVDGGDLHASIDSFLIQKEEISLKELDFKIRQQLVNNYGLYKGTSKYGKIIINLKDENKVEIDLSDKLQFERMGDVLNSKDIRGIAVTINQI

SEQ ID NO: 35182 - protein, 234 aa, Staphylococcus aureus
  subsp. aureus 21310
MKIRTIVKASLALSILATGVITSTAQTVNASEHEAKYENVTKDIFDLRDYYSGESKALKNVIGYHYSKGGRHYLVIDKNRKFTRVQIFGKDIERFKARKNPGLDIFVVKEAENRNGTVYSYGGVTKKNQGAYYDYINAPRFQIKRDEGDGIATYGRVHYIYKEEVSLKELDFKLRQYLIQNFDLYKKFPKDSKIKVIMKDGGYYTFELNKKLQTNRMSDVIDGRNIEKIEANIR

SEQ ID NO: 35183 - protein, 343 aa, Staphylococcus aureus
  subsp. aureus 21310
MKIRTIAKASLALGLVTTGASIVTTQSANAEVASALKAGQLAKINVSSSAVTTTTQAVNAEQNRTANTEQASKSNTEKVSTSPSIKTEQTPKSNTQKATQPTPSGTTQPLPNAQPQSPQSTPNASTSPSSSVETQQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKARISITKEDEKGKISRDDSEYKITKEEISLKELDFKLRKQLIEQHNLYGNIGSGTIVIKTKNGGKYTFELHKKLQEHRMADVIDGTSIDRIEVNLKSS

SEQ ID NO: 35184 - protein, 233 aa, Staphylococcus aureus
  subsp. aureus 21310
MKMKSIAKVSLVLGILATGVNTVTEQPVHAENKPIQVSQNSKNLKAYYTQPSVEYKNVTGYISSIQPKAGTKFMNIIEGNTVNNLALVGKDKQHYHTGVHRNLDIFYVNEDKRFEGSKYSIGGITEASDKAVDQIAEARVIKEDHTGEYDYDFFPFKIDKEAMTLKEVDFKIRKHLIDHYGLYGEMSSGTVTVKMKYYGKYTFELDKKLQEDRMADIIKVTDIDRIEVIVKKA

SEQ ID NO: 35185 - protein, 226 aa, Staphylococcus aureus
  subsp. aureus 21310
MKFKAIAKASLALGMLATGVITSNVQSVQAKAEVKQQSEADLKLYYSGPSFEYKKVTGYGFVEGKDRFIDFIYNGQYNKISLVGSDKDKYNEEVNPDIDVFVVREGNGRQADNHSIGGVTKTNRGVYYDYIHTPILEIKKGKEEPQSSLYQIYKEDISLKELDYRLRERAIKHHGLYSKGLKQGQITITMNDGTTHTIDLSQKLEKERMGQSVDGKQIQKILVEMK

SEQ ID NO: 35186 - protein, 203 aa, Staphylococcus aureus
  subsp. aureus 21310
MFKKHHSKNSILLKSILSLGIIYSGSFGIYSKAGASTQNSSSLQDKQFQKVEEVPNNSEKALVKKLYDRYSKNTINGKSNKSRNWVYSERPLNENQVRIHLEGTYTVADRVYTPKRNITLNKEVVTLKELDHIIRFAHISYGLYMGEHLPKGNIVINTKDGGKYTLESHKELQKDRENVKINTADIKNVTFDLVKSVNDIEQV

SEQ ID NO: 35187 - protein, 691 aa, Staphylococcus aureus
  subsp. aureus 21310
MLRGQEERKYSIRKYSIGVVSVLAATMFIVSSHEAQASEKTPTSNAAAQKETLNQPGEQGNTITSHQMQSGKQLDDMHKENGKSGTVTEGKDTLQSSKHQSTQNSKTIRTQNDNQVKQDSERQGSKQSHQNNAINKTERQNDQVQNTHHAERNGSQSTTSQSNDVDKSQPSIPAQKVLPHHDKAAPTSTTPPSNDKTAPKSTKAQDATTDKHPNQQDTHQPAHQIIDATQDDTVRQSEQKPQVGDLSKHIDGQNSSEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFINVTNDEPATRRGIWQVKPIIQGWDHVDFIGVDFLDFKRKGAELANFYTGIINDLLRVEATEGKGTQLKAS

SEQ ID NO: 35188 - protein, 169 aa, Staphylococcus aureus
  subsp. aureus 21310
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKNNKMLSMKS

SEQ ID NO: 35189 - protein, 102 aa, Staphylococcus aureus
  subsp. aureus 21310
PKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 35190 - protein, 250 aa, Staphylococcus aureus
  subsp. aureus 21310
MGEFEVKYLTGFILILLLEGIFTNSASAIEYSDLHHKSELDSKRLYNAKVSFANPTQLENKKTNDRLLKHDLLFHDMFVNDAWKKDFKVEFENEALSKKFVNKDIDIFAGNYGYGCHGGETNKTLCSYGGVTLSDNNKYDDYKNIPCNLWIDGHQTGIELTAVKTKKKIVTIQELDVQLRNYLNEKYKLYELGGDIVKGYVKYHNDDEKNVEYDFYNLNGEYGHEVLKMYADNKTINSDKLHLDIYLFKS

SEQ ID NO: 35191 - protein, 291 aa, Staphylococcus aureus; identical to SEQ ID NO: 30390
  subsp. aureus 21310

SEQ ID NO: 35192 - protein, 895 aa, Staphylococcus aureus
  subsp. aureus 21310
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDKNDAVVTNDQSSSDASNQTNTNTSNQNTSTTNNTSDQPYATTNMSQPAQPVSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDIKTKDDATSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPNDIHKTVDKTVKTKEKAGTPSKENKLSQSKMLPKTGETTSSQSWWGLYALLGMLALFIPKFRKESK

SEQ ID NO: 35193 - protein, 2189 aa, Staphylococcus aureus
  subsp. aureus 21310
MNLLKKNKYSIRKYKVGIFSTLIGTVLLLSNPNGAQALTTDQNVQGESNQALPGNSHNTNVDTSRDITNSSQNTPNQHTTANASTNQALANHHNVGESNQVVPMPVQPSTSSASNNNHSDAKSTATESAANTNNNLSSNNNTLNVPNNTDNNDSARHLTLKEIQEDVRHSSDKPELVAIAEEASNRPKKRSRRAAPADPNATPADPTATPADPAAGNGSAPVAITAPYTPTTDPNANNIGQNAPNEVLSFDDNGIRPSTNRSVPTVTVVDNLPGFTLINGGKVGVFSHAMVRTSMFDSGDAKNYQAQGNVIALGRIRGNDVNDHGDFNGIEKTLTVNPNSELIFEFNTMTTKNYQGMTNLVIKNADNDAVIGEKVVAYGPIWRLFKVPENVSHLKIQFVPKNDAITDPRGIYQLRDGYKYYDFVDSIGLHSGSHVYVERRTMEPTATNNKEFSVTTSLKNNGNFGASFNTDDFVYKIQLPEGVEYVNNSLTKDFQSGNSGVDINDFNVTYDAANRIITIKSTGGGSGNSPARLMPDKILDLKYKLRVNNVPTPRTVTFNDTLTYKTFSQDFINSPAESHTVSTEPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSRDTATPVVKPNAKQAIRDKAAKQREIINNTPDATQDEIQDALNQLTTDETDAIDNVTNATTNADVETAKNNGINTIGAVVPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIDKVNAAVAAANANILNANTNADVEQVKTNAIQGIQAIEPATKVKTDAKNAIDQSAETQHNAIFNNNDATLEEQQAAQQLLDQAVATAKQNINAADTNQEVAQAKDQGMQNIVVIQPATQVKTDARNTVNEKAREVITNINATPGATREEKQEAIDRVNALKNRALTDIGVTSTTAMVNSIRDDAVNQIGAVQPHVTKKQTATGVLNDLATAKKQEINQNTNATTEEKQIALNQVDQELAAALNNINQADTNAEVDQAQQLGAQAINAIQPNIVKKPAALAQINQHYNAKLAEINATPDATDDEKNAAINTLNQDRQQAIESLNQANTNNEVDQAAITAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSIDSTDNEKEVATQALAREKEKALVAIEQAQTNEQVNQAATDGITAIKIIQPETRVKPAAREKINQKANELRAQINQDKEATAEERQAALDKINDLVTQAMTNITSDRTDQQVNDSTNQALGDIALVTPDHIIRAAARDAVKQQYEAKKQEIEQAEHATDEEKQVALNQLANNEKRALQNIDQAIANNDVKRVESNGIATLKGVEPHIVVKPEAQQAIKASADNQVESIKDTPHATTDELDEANQQINDTLKQGQQDIDNTTQDVAVNDVRNQTIKAIEQIKPKVRRKRAALDNIDESNNNQLDAIRNTLDTTQDERNIAIAELNKIVNTIKNDIAQNKTNAEVDQTEADGNNNIKVILPKVQVKPAARHSVSAKAEAQNALIDQSDLSTEEERLAAKHLVDQALNQAIDQINHADKTAQVNQNSIDAQKIISQIKPATTVKTTALQQIQNIATNKINLIKANNEATDEEQNAAIAQVEQALIKAKQQIASAVTNADVAYLLHDGKNEIREIEPVINRKSTAREQLTTLLNDKKQAIEANVQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKIARTNADVDAVLKRFKVALGDIEAVITEKENSLLRIDNIAQQTYAKFKSIATPEQLAKVKALIDQYVADGNRMIDEDATLNDIKQHTQFIVDEILAIKLPAEVTNVSPKVGQPAPKVCTPIKKEDKQEVHKVEKELPNTGSEEMDLPLKELALITGAALLARRRTKNEKES

SEQ ID NO: 35194 - protein, 258 aa, Staphylococcus aureus; identical to SEQ ID NO: 30410
  subsp. aureus 21310

SEQ ID NO: 35195 - protein, 165 aa, Staphylococcus aureus; identical to SEQ ID NO: 30805
  subsp. aureus 21310

SEQ ID NO: 35196 - protein, 256 aa, Staphylococcus aureus
  subsp. aureus 21310
MKLFAFIFICVKSCSLLFMLNGNPKPEQLNKASEFTGLMDNMRYLYDDKHVSETNIKSQEKFLQHDLLFKISGSKILKTEFNNKSLSDKYKNKNVDLFGTNYYNQCYFSSDNMELNDGRLIEKTCMYGGVTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 35197 - protein, 242 aa, Staphylococcus aureus
  subsp. aureus 21310
MKKFKYSFILVFILLFNIKDHTYAQGDIGVGNLRNFYTKHDYIDLKGVTDKNLPIANQLEFSTGTNDLISESNNWDEISKFKGKKLDIFGIDYNGPCKSKYMYGGATLSGQYLNSARKIPINLWVNGKHKTISTDKIATNKKLVTAQEIDVKLRRYLQEEYNIYGHNNTGKGKEYGYKSKFYSGFNNGKVLFHLNNEKSFSYDLFYTGDGLPVSFLKIYEDNKIIESEKFHLDVEISYVDSN

SEQ ID NO: 35198 - protein, 239 aa, Staphylococcus aureus
  subsp. aureus 21310
MKRILIIVVLLFCYSQNHIATADVGVLNLRNYYGSYPIEDHQSINPENNHLSHQLVFSMDNSTVTAEFKNVDDVKKFKNHAVDVYGLSYSGYCLKNKYIYGGVTLAGDYLEKSRRIPINLWVNGEHQTISTDKVSTNKKLVTAQEIDTKLRRYLQEEYNIYGFNDTNKGRKYGNKSKFSSGFNAGKILFHLNDGSSFSYDLFDTGTGQAESFLKIYNDNKTVETEKFHLDVEISYKDES

SEQ ID NO: 35199 - protein, 254 aa, Staphylococcus aureus; identical to SEQ ID NO: 30809
  subsp. aureus 21310

SEQ ID NO: 35200 - protein, 325 aa, Staphylococcus aureus
  subsp. aureus 21310
MNMNKLVKSSVATSMALLLLSGTANAEGKITPVSVKKVDDKVTLYKTTATADSDKFKISQILTFNFIKDKSYDKDTLVLKAAGNINSGYERPNPKDYDFSKIYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNEIFLAGRQSSSYAGQNFIAQHQMPLLSRSNFNPEFLSVLSHRQDGAKKSKITVTYQREMDLYQIRWNGFYWAGANYKNFKTRTFKSTYEIDWENHKVKLLGTKETENNK

SEQ ID NO: 35201 - protein, 315 aa, Staphylococcus aureus
  subsp. aureus 21310
MLKNKILATTISVSLLAPLANPLLENAKAANDTEDIGKGNDVEIIKRTEDKTSNKWGVTQNIQFDFVKDKKYNKDALILKMQGFISSRTTYYNYKNTNHIKSMRWPFQYNIGLKTNDPNVSLINYLPKNKIESTNVSQTLGYNIGGNFQSAPSLGGNGSFNYSKSISYTQQNYVSEVEQQNSKSVLWGVKANSFVTASGQKSAFDSDLFVGYKPNSKDPRDYFVPDSELPPLVQSGFNPSFIATVSHEKGSGDTSEFEITYGRNMDVTHAIKRSTHYGNSYLDGHRVHNAFKNRNYTVKYEVNWKTHEIKVKGQN

SEQ ID NO: 35202 - protein, 321 aa, Staphylococcus aureus; identical to SEQ ID NO: 31900
  subsp. aureus 21310

SEQ ID NO: 35203 - protein, 325 aa, Staphylococcus aureus; identical to SEQ ID NO: 30484
  subsp. aureus 21310

SEQ ID NO: 35204 - protein, 312 aa, Staphylococcus aureus; identical to SEQ ID NO: 30391
  subsp. aureus 21310

SEQ ID NO: 35205 - protein, 808 aa, Staphylococcus aureus
  subsp. aureus 21310
MTYRMKKWQKISTITLLMAGVITFNDSEFRSVDKHQIAVADTNVQTTDYEKLRNTWLNVNYGYNQYDENNDAMKKKFEATEKEATNLLSSMKTESDRKYLWENSKDLDTKSADMTRTYRNIEKIAEAMKHKNTKLNTPDNKNKVKDALEWLHKNAYGKEPTDKVKELTENFKNKTSRNTNLNWWDYEIGTPRALTNTLILLNGDISSDEKKKYTAPIKTFAPESDKILSSVGQPEQAKGGNLVDIAKVKLLESIIEEDTTMMKESIDAFNKVFTYVQSNATGKERNGFYKDGSYIDHQDVPYTGAYGVVLLEGISQMMPMIKETSFKDSNQNDTTLKSWIDEGFMPLIYKGEMMDLSRGRAISRENETSHSVSATVMKSLLRLSDAMDDSTKAKYKQIVKTSVKSDSSYKQNDYLSSYSDISKMKSLMEDSTISTNDLTQQLKIYNDMDRVTYHNKGLDFAFGLSMTSKNVARYESINNENLKGWHTGAGMSYLYNSDVKHYRDNFWATADMKRLAGTTTIENEEPKGTDVKKSSKTFVGGTKFDDQHASIGMDFENQDKTLTAKKSYFILNDKIVFLGTGIKSTDSSKNPVTTIENRKTNGYTLYTDDKQTTASDNQDTNSVFLESTNKPKNNIGYHFLNKSKITVKKESHTGKWSDINKSQKSEDKTDEYYEVTQKHSDKDNKYGYVLYPGITKDNFKSKASQVTVVKQDDDFHVVKDNESVWAGVNYSDSAKTFEINGTKVEVKAKGMFILKKKNDKTYECSFYNPESTNPASDIESKISMTGYSITNKDTSTTNESGVRFELTK

SEQ ID NO: 35206 - protein, 141 aa, Staphylococcus aureus; identical to SEQ ID NO: 31189
  subsp. aureus 21310

SEQ ID NO: 35207 - protein, 1153 aa, Staphylococcus aureus; identical to SEQ ID NO: 30596
  subsp. aureus 21318

SEQ ID NO: 35208 - protein, 1379 aa, Staphylococcus aureus
  subsp. aureus 21318
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 35209 - protein, 51 aa, Staphylococcus aureus; identical to SEQ ID NO: 32614
  subsp. aureus 21318

SEQ ID NO: 35210 - protein, 392 aa, Staphylococcus aureus
  subsp. aureus 21318
MEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 35211 - protein, 252 aa, Staphylococcus aureus
  subsp. aureus 21318
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKAVKPAAKATNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEENTITH

SEQ ID NO: 35212 - protein, 350 aa, Staphylococcus aureus; identical to SEQ ID NO: 30602
  subsp. aureus 21318

SEQ ID NO: 35213 - protein, 638 aa, Staphylococcus aureus
  subsp. aureus 21318
MNYRDKIQKFSIRKYTVGTFSTVIATLVFLGFNTSQAHAAETNQPASVVKQKQQSNNEQTENRESQVQNSQNSQNSQSLSATHENEQPNNSQANLVNQKVAQSSTTNDEQPASQNVNTKKDSATAATTQPDKEESKHKQNESQSANKNGNDNRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPDRSHDFKIRNRSGQVIYSWPTVHVYSLEDLSRASDYFSEAGATPATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYPTNANTNAFRPGGVQELNEYQLSQLFTDQKITRSSKN

SEQ ID NO: 35214 - protein, 258 aa, Staphylococcus aureus; identical to SEQ ID NO: 30228
  subsp. aureus 21318

SEQ ID NO: 35215 - protein, 268 aa, Staphylococcus aureus; identical to SEQ ID NO: 30398
  subsp. aureus 21318

SEQ ID NO: 35216 - protein, 259 aa, Staphylococcus aureus; identical to SEQ ID NO: 30226
  subsp. aureus 21318

SEQ ID NO: 35217 - protein, 241 aa, Staphylococcus aureus; identical to SEQ ID NO: 30608
  subsp. aureus 21318

SEQ ID NO: 35218 - protein, 241 aa, Staphylococcus aureus; identical to SEQ ID NO: 30607
  subsp. aureus 21318

SEQ ID NO: 35219 - protein, 238 aa, Staphylococcus aureus; identical to SEQ ID NO: 30606
  subsp. aureus 21318

SEQ ID NO: 35220 - protein, 891 aa, Staphylococcus aureus; identical to SEQ ID NO: 30788
  subsp. aureus 21318

SEQ ID NO: 35221 - protein, 2186 aa, Staphylococcus aureus
  subsp. aureus 21318
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQKINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 35222 - protein, 331 aa, Staphylococcus aureus; identical to SEQ ID NO: 30615
  subsp. aureus 21318

SEQ ID NO: 35223 - protein, 211 aa, Staphylococcus aureus; identical to SEQ ID NO: 30592
  subsp. aureus 21318

SEQ ID NO: 35224 - protein, 188 aa, Staphylococcus aureus
  subsp. aureus 21318
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKTQQI

SEQ ID NO: 35225 - protein, 910 aa, Staphylococcus aureus
  subsp. aureus 21318
MIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 35226 - protein, 1015 aa, Staphylococcus aureus
  subsp. aureus 21318
MIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYIFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVLSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 35227 - protein, 233 aa, Staphylococcus aureus; identical to SEQ ID NO: 30591
  subsp. aureus 21318

SEQ ID NO: 35228 - protein, 319 aa, Staphylococcus aureus; identical to SEQ ID NO: 30605
  subsp. aureus 21318

SEQ ID NO: 35229 - protein, 825 aa, Staphylococcus aureus; identical to SEQ ID NO: 33636
  subsp. aureus 21318

SEQ ID NO: 35230 - protein, 165 aa, Staphylococcus aureus; identical to SEQ ID NO: 30418
  subsp. aureus 21318

SEQ ID NO: 35231 - protein, 54 aa, Staphylococcus aureus; identical to SEQ ID NO: 34430
  subsp. aureus 21318

SEQ ID NO: 35232 - protein, 241 aa, Staphylococcus aureus; identical to SEQ ID NO: 30571
  subsp. aureus 21318

SEQ ID NO: 35233 - protein, 492 aa, Staphylococcus aureus
  subsp. aureus 21318
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMSNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35234 - protein, 291 aa, Staphylococcus aureus; identical to SEQ ID NO: 30390
  subsp. aureus 21318

SEQ ID NO: 35235 - protein, 659 aa, Staphylococcus aureus; identical to SEQ ID NO: 33656
  subsp. aureus 21318

SEQ ID NO: 35236 - protein, 119 aa, Staphylococcus aureus
  subsp. aureus 21318
MYPGLSKDDFNTKKDKVTVVKQDDDFHVVKDNESVWAGVNYSNSTQTFDINNTKVEVKAKGMFILKNKDDNTYECSFYNPESTNTASDIESKISITGYSITNKNTSTSNESGVHFELTK

SEQ ID NO: 35237 - protein, 141 aa, Staphylococcus aureus; identical to SEQ ID NO: 30633
  subsp. aureus 21318

SEQ ID NO: 35238 - protein, 242 aa, Staphylococcus aureus; identical to SEQ ID NO: 30814
  subsp. aureus 21318

SEQ ID NO: 35239 - protein, 274 aa, Staphylococcus aureus; identical to SEQ ID NO: 30872
  subsp. aureus 21318

SEQ ID NO: 35240 - protein, 338 aa, Staphylococcus aureus; identical to SEQ ID NO: 30627
  subsp. aureus 21318

SEQ ID NO: 35241 - protein, 351 aa, Staphylococcus aureus; identical to SEQ ID NO: 30628
  subsp. aureus 21318

SEQ ID NO: 35242 - protein, 258 aa, Staphylococcus aureus; identical to SEQ ID NO: 30410
  subsp. aureus 21318

SEQ ID NO: 35243 - protein, 165 aa, Staphylococcus aureus; identical to SEQ ID NO: 30805
  subsp. aureus 21318

SEQ ID NO: 35244 - protein, 37 aa, Staphylococcus aureus; identical to SEQ ID NO: 30806
  subsp. aureus 21318

SEQ ID NO: 35245 - protein, 242 aa, Staphylococcus aureus; identical to SEQ ID NO: 30399
  subsp. aureus 21318

SEQ ID NO: 35246 - protein, 239 aa, Staphylococcus aureus; identical to SEQ ID NO: 30622
  subsp. aureus 21318

SEQ ID NO: 35247 - protein, 254 aa, Staphylococcus aureus; identical to SEQ ID NO: 30809
  subsp. aureus 21318

SEQ ID NO: 35248 - protein, 327 aa, Staphylococcus aureus; identical to SEQ ID NO: 30616
  subsp. aureus 21318

SEQ ID NO: 35249 - protein, 311 aa, Staphylococcus aureus; identical to SEQ ID NO: 30617
  subsp. aureus 21318

SEQ ID NO: 35250 - protein, 227 aa, Staphylococcus aureus; identical to SEQ ID NO: 30586
  subsp. aureus 21318

SEQ ID NO: 35251 - protein, 2481 aa, Staphylococcus aureus
  subsp. aureus 21318
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKKIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 35252 - protein, 231 aa, Staphylococcus aureus; identical to SEQ ID NO: 30630
  subsp. aureus 21318

SEQ ID NO: 35253 - protein, 577 aa, Staphylococcus aureus
  subsp. aureus 21318
MKFKSLITTTLALGVIASTGANFNTNEASAAAKPLDKSSSTLHHGHSNIQIPYTITVNGTSQNILSSLTFNKNQNISYKDIENKVKSVLYFNRGISDIDLRLSKQAEYTVHFKNGTKRVIDLKSGIYTADLINTSDIKAISVNVDTKKQPKDKAKANVQVPYTITVNGTSQNILSNLTFNKNQNISYKDLEGKVKSVLESNRGITDVDLRLSKQAKYTVNFKNGTKKVIDLKSGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADRYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKINKSNNVKFPVTINKFENIVSNEFVFYNASKITINDLSIKLKSAMANDQGITKHDIGLAERAVYKVYFKNGSSKYVDLKTEYKDERVFKATDIKKVDIELKF

SEQ ID NO: 35254 - protein, 434 aa, Staphylococcus aureus [sequence omitted]

SEQ ID NO: 35255 - protein, 989 aa, Staphylococcus aureus
  subsp. aureus 21318
MNMKKKEKHAIRKKSIGVASVLVGTLIGFGVLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 35256 - protein, 372 aa, Staphylococcus aureus; identical to SEQ ID NO: 30609
  subsp. aureus 21318

SEQ ID NO: 35257 - protein, 266 aa, Staphylococcus aureus
  subsp. aureus 21318
PTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 35258 - protein, 325 aa, Staphylococcus aureus; identical to SEQ ID NO: 30407
  subsp. aureus 21318

SEQ ID NO: 35259 - protein, 315 aa, Staphylococcus aureus; identical to SEQ ID NO: 30573
  subsp. aureus 21318

SEQ ID NO: 35260 - protein, 209 aa, Staphylococcus aureus
  subsp. aureus 21318
MIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 35261 - protein, 86 aa, Staphylococcus aureus
  subsp. aureus 21318
MNLKLNRKKVISMIKNKILTATLAVGLIAPLANPFIEISKAENKIEDIGQGAEIIKRTQDITSKRLAITQNIQFDFVKDKNITKMP

SEQ ID NO: 35262 - protein, 62 aa, Staphylococcus aureus; identical to SEQ ID NO: 30610
  subsp. aureus 21318

SEQ ID NO: 35263 - protein, 138 aa, Staphylococcus aureus; identical to SEQ ID NO: 30785
  subsp. aureus 21318

SEQ ID NO: 35264 - protein, 227 aa, Staphylococcus aureus; identical to SEQ ID NO: 30585
  subsp. aureus 21318

SEQ ID NO: 35265 - protein, 232 aa, Staphylococcus aureus; identical to SEQ ID NO: 30584
  subsp. aureus 21318

SEQ ID NO: 35266 - protein, 232 aa, Staphylococcus aureus; identical to SEQ ID NO: 30583
  subsp. aureus 21318

SEQ ID NO: 35267 - protein, 231 aa, Staphylococcus aureus; identical to SEQ ID NO: 30582
  subsp. aureus 21318

SEQ ID NO: 35268 - protein, 234 aa, Staphylococcus aureus; identical to SEQ ID NO: 30581
  subsp. aureus 21318

SEQ ID NO: 35269 - protein, 292 aa, Staphylococcus aureus; identical to SEQ ID NO: 30580
  subsp. aureus 21318

SEQ ID NO: 35270 - protein, 356 aa, Staphylococcus aureus; identical to SEQ ID NO: 30793
  subsp. aureus 21318

SEQ ID NO: 35271 - protein, 231 aa, Staphylococcus aureus; identical to SEQ ID NO: 30578
  subsp. aureus 21318

SEQ ID NO: 35272 - protein, 226 aa, Staphylococcus aureus; identical to SEQ ID NO: 30577
  subsp. aureus 21318

SEQ ID NO: 35273 - protein, 203 aa, Staphylococcus aureus; identical to SEQ ID NO: 30576
  subsp. aureus 21318

SEQ ID NO: 35274 - protein, 691 aa, Staphylococcus aureus; identical to SEQ ID NO: 30511
  subsp. aureus 21318

SEQ ID NO: 35275 - protein, 877 aa, Staphylococcus aureus; identical to SEQ ID NO: 30593
  subsp. aureus 21318

SEQ ID NO: 35276 - protein, 2259 aa, Staphylococcus aureus
  subsp. aureus 21318
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDLSSTSTSTSLSDSMSQSQSTSTSASGSLSTSISTSMSMSASTSSSQSTSVSTSLSTSDSISDSTSISISGSQSTVESESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 35277 - protein, 681 aa, Staphylococcus aureus; identical to SEQ ID NO: 30598
  subsp. aureus 21318

SEQ ID NO: 35278 - protein, 274 aa, Staphylococcus aureus; identical to SEQ ID NO: 30872
  subsp. aureus 21331

SEQ ID NO: 35279 - protein, 338 aa, Staphylococcus aureus; identical to SEQ ID NO: 31183
  subsp. aureus 21331

SEQ ID NO: 35280 - protein, 351 aa, Staphylococcus aureus; identical to SEQ ID NO: 31184
  subsp. aureus 21331

SEQ ID NO: 35281 - protein, 805 aa, Staphylococcus aureus
  subsp. aureus 21331
MNMKKQEKHAIRKKSIGVASVLVGTLIGFGLLSSKEADASENSMTQTENTRNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDTSTEVTPSNNESAPQSTDASNKDVVNQTVNTSASRMRAFSLAAADAPAVGTDITNQLTNVTVGIDSGTTVYPHQAGYVKLNYGFSVPNSAVQGDTFKITVPKELNLNGVTSTAKVPPIMAGDQVLANGVIDSDGNVIYTFTDYVDTKNDVKATLTVPAYIDPENVTKTGNVTLTTGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSASDSDSASDSDSTSDSDSTSDSDSASDSDSASDSDSTSDSDSTSDSDSVSDSDSASDSDSDSDSDSDSDSDSDSDSDSDSDSDSDSDSDSDSDSDSDSDSDSDSDSDSDSDSDSDSDSDSDSESDSDSDSDSESESDSDSDSDSDSDSDSDSDSDSDSDSDSDSDSDSDSDSDSDSDSASDSDSDSDSDSDSDSDSDSDSDNDS

SEQ ID NO: 35282 - protein, 434 aa, Staphylococcus aureus [sequence omitted]

SEQ ID NO: 35283 - protein, 2459 aa, Staphylococcus aureus; identical to SEQ ID NO: 32108
  subsp. aureus 21331

SEQ ID NO: 35284 - protein, 70 aa, Staphylococcus aureus; identical to SEQ ID NO: 31174
  subsp. aureus 21331

SEQ ID NO: 35285 - protein, 241 aa, Staphylococcus aureus; identical to SEQ ID NO: 31173
  subsp. aureus 21331

SEQ ID NO: 35286 - protein, 241 aa, Staphylococcus aureus
  subsp. aureus 21331
MKNNLTKKIILSIALTMIGTATSQSPHSPISMSSEAKAYNISESETNVNELTKYYTQRHLTFSNKWLWQKDNGTIHATLLQLSWFSHIQVFGPESWGNINQLRNKYVDIFALKDYETWRTYMLAQETFTGGVTPAAKPSDKYYKLNVTYKDKAGTFIGEYQFYTGNKPVLTLKEVDFRIRQTLIKNKKLYNGDYNKGHIKITGGSNNYPIDLSKRLKSTDANRYVKNPQTAHIEILLEKPS

SEQ ID NO: 35287 - protein, 238 aa, Staphylococcus aureus; identical to SEQ ID NO: 31171
  subsp. aureus 21331

SEQ ID NO: 35288 - protein, 319 aa, Staphylococcus aureus; identical to SEQ ID NO: 31170
  subsp. aureus 21331

SEQ ID NO: 35289 - protein, 165 aa, Staphylococcus aureus; identical to SEQ ID NO: 31169
  subsp. aureus 21331

SEQ ID NO: 35290 - protein, 105 aa, Staphylococcus aureus; identical to SEQ ID NO: 31168
  subsp. aureus 21331

SEQ ID NO: 35291 - protein, 354 aa, Staphylococcus aureus; identical to SEQ ID NO: 31167
  subsp. aureus 21331

SEQ ID NO: 35292 - protein, 642 aa, Staphylococcus aureus
  subsp. aureus 21331
MNKQQKEFKSFYSIRKSSLGVASLAISTLLLLMSNGEAKAAEETGGTNTEAQPKTEAVASPTTTTTEKAPEAKPVANAVSVANKEVVAPTTETKEVKEVKAPKEAKEEKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKETTPATPSKPTTPPVEKESQKQDSQKDDNKQSASVEKENDASSESAKDKTPATKPAKAEVESSSTTPTKVVSTTQNVAKPTTASSETTKDVVQTSAGSSEAKDSAPLQKANIKNTNDGDTQSQNNKNTQENKAKSLPQTGEESNKDMTLPLMALLALSSIVAFVLPRKRKN

SEQ ID NO: 35293 - protein, 250 aa, Staphylococcus aureus; identical to SEQ ID NO: 31175
  subsp. aureus 21331

SEQ ID NO: 35294 - protein, 291 aa, Staphylococcus aureus; identical to SEQ ID NO: 30390
  subsp. aureus 21331

SEQ ID NO: 35295 - protein, 895 aa, Staphylococcus aureus; identical to SEQ ID NO: 31177
  subsp. aureus 21331

SEQ ID NO: 35296 - protein, 2182 aa, Staphylococcus aureus
  subsp. aureus 21331
MNLLKKNKYSIRKYKVGIFSTLIGTVLLLSNPNGAQALTTDHNVQGGSNQALPGNSPNTNADTNRDIVNGSQNTPNAHATDNTSTNQALTNHQNVGVANQVAPAPIQPSTSSASNNNHSDANSTATEPAANTNNNLASNNNTLNVPNNTDNNDSARHLTLKEIQEDVRHSFDKPELVAIAEEASNRPKKRSRRAAPADPNATPADPTAGNGSAPVAITAPFTPTTDPNANNIGQNAPNEVLTFDDNNIRPSTNRSVPTVTVVDNLPGYTLINGGKVGVFSHAMVRTSMFDSGDAKNYQAQGNVIALGRIKGNDTNDHGGFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDILTYKTYTQDFINSPAESHTVSTNPYTIDIIMNKDVLQAEVDRRIQQADYTFASLDIFNELKRRAQTILDENRNNVPLNKRVSQADIDSLVNQMQHTLIRSVDAENAVNRKVDDMEDLVNQNDELTDEEKQAAIQVIEEHKNEIIGNIGDQTTDDGVTRIKDQGIQTLSGDTATPVVKTNAKQAIRDKAAKQREIINNTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAAANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALNDIGVTSTTAMVNSIRDDAVNQIGAVQPHVTKKQTATGVLTDLATAKKQEINQNTNATDEEKQVALNQVDQDLATAINNINQADTNAEVDQAQQLGTKAINAIQPNIVKKPTALAQINQHYNAKLAEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAKVVIKPKAIADIEKAVKEKQQQIDNSLDSTDNEKEVALLALAKEKEKALAAIDQAQTNSQVNQAATNGVSAIKIIQPETKVKPAAREKINQKANELRAQINQDKEATAEERQAALDKINDLVAKAMTNITNDRTNQQVNDSTNQALDDIALVTPDHIVRATARDAVKQQYEAKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIASAVTNADVAYLLHDGKNEIREIEPVINKKATAREQLTTLFNDKKLAIEANVQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGIRMIDEDATLNDIKQHTQFIVDEILAIKLPAEATKVLPKVGQPAPKLCTSIKKVDKQEVRKVVKELPNTGSEEMDLPLKELALITGAALLARRRNKNEKES

SEQ ID NO: 35297 - protein, 331 aa, Staphylococcus aureus; identical to SEQ ID NO: 31179
  subsp. aureus 21331

SEQ ID NO: 35298 - protein, 807 aa, Staphylococcus aureus; identical to SEQ ID NO: 31180
  subsp. aureus 21331

SEQ ID NO: 35299 - protein, 141 aa, Staphylococcus aureus; identical to SEQ ID NO: 31189
  subsp. aureus 21331

SEQ ID NO: 35300 - protein, 809 aa, Staphylococcus aureus; identical to SEQ ID NO: 31188
  subsp. aureus 21331

SEQ ID NO: 35301 - protein, 681 aa, Staphylococcus aureus; identical to SEQ ID NO: 31198
  subsp. aureus 21331

SEQ ID NO: 35302 - protein, 2279 aa, Staphylococcus aureus; identical to SEQ ID NO: 31197
  subsp. aureus 21331

SEQ ID NO: 35303 - protein, 564 aa, Staphylococcus aureus
  subsp. aureus 21331
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTKDANSIATNSELKNPQTLDLPQSSPQTISNAQGTSKPSVRTRAVRSLTVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFNNRIFYEHPNVASINFGDINKTYVVLVEGHYDNTGKNLKTQVIQENIDPATGKDYSIFGWNNENVVRYGGGSADGDSAVNPVDPTPGPPVDPEPEPEPTPDP

SEQ ID NO: 35304 - protein, 1139 aa, Staphylococcus aureus
  subsp. aureus 21331
MINRDNKKAITKKGMISNRLNKFSIRKYTVGTASILVGTTLIFGLGNQEAKAAENTSTENAKQDEASTSDNKEVVSETENNSTTENTSTNPIKKETNTDSQPETKEESTTSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDRSTKPVATAPTSVAPKRLNAKMRFAVAQSAAVASNNVNDLIKVTKQTIKVGDGKDDVVAAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQNIEQQIYVNPLKKTATNTKVDIAGSQVDDYGNIKLGNGSTIIDQNTEIKVYKVNSNQQLPQSNRIYDFSQYEDVTSQFDNKKSFSNNVATLDFGNIDSAYIIKVVSKYTPTSDDELDIAQGASMRTTDKNNYYNYAGYSNFIVTSTDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKIIGTTTTDASGKYKFTDLDNGNYTVEFETPAGYTPTLKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTIDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTGKHIPVKPMSATKDHDNKAKALPETGSENNGSNNATLFGGLFAALGSLLLFGRRKKQNK

SEQ ID NO: 35305 - protein, 1390 aa, Staphylococcus aureus; identical to SEQ ID NO: 32104
  subsp. aureus 21331

SEQ ID NO: 35306 - protein, 972 aa, Staphylococcus aureus
  subsp. aureus 21331
MNNKKTATNRKGMIPNRLNKFSIRKYSVGTASILVGTTLIFGLSGHEAKAAEHTNGELNQSKNETTVPTENKTTEKVDSRQQNNIEQSTTSNQPKVNESDNTSVKETTEEPQNTTSTQSTKQNNDATANKDNLEAQNISTQAKDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLKEVTNQFNITYSNDNKTATVDLLNGQTSSNKQYIIQQVAYPDNTSTDNGKIDYTLETQNGKSSWSNSYSSVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNNAKALPETGSENNGSNNATLFGGLFAALGSLLLFGRRKKQNK

SEQ ID NO: 35307 - protein, 241 aa, Staphylococcus aureus; identical to SEQ ID NO: 31149
  subsp. aureus 21331

SEQ ID NO: 35308 - protein, 492 aa, Staphylococcus aureus
  subsp. aureus 21331
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKKPGKEDGNKPGKEDNKKPGKEDGNKPGKEDGNGIHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35309 - protein, 321 aa, Staphylococcus aureus; identical to SEQ ID NO: 31190
  subsp. aureus 21331

SEQ ID NO: 35310 - protein, 315 aa, Staphylococcus aureus; identical to SEQ ID NO: 31191
  subsp. aureus 21331

SEQ ID NO: 35311 - protein, 325 aa, Staphylococcus aureus; identical to SEQ ID NO: 30479
  subsp. aureus 21331

SEQ ID NO: 35312 - protein, 97 aa, Staphylococcus aureus
  subsp. aureus 21331
SDSDSDSTSDTGSDNDSDSESDSNSDSESGSNNNVVPPNSPKNGTNASNKNEAKDSKEPLPDTGSEDEANTSLIWGLLASLGSLLLFRRKKENKDKK

SEQ ID NO: 35313 - protein, 231 aa, Staphylococcus aureus; identical to SEQ ID NO: 30654
  subsp. aureus 21331

SEQ ID NO: 35314 - protein, 689 aa, Staphylococcus aureus; identical to SEQ ID NO: 31181
  subsp. aureus 21331

SEQ ID NO: 35315 - protein, 226 aa, Staphylococcus aureus
  subsp. aureus 21331
MKLKNIAKASLALGILTTGMITTTAQPVKASTLEVRSQATQDLKGYYSGTGFNFQNVSGYRENDKMNLFSGSQLNVISLLGSDKERFKNSDYSGLDVFVVREGSGRQADNNSIGGITKTNKNNYKDFVNNVGLEITKPTGHNTATRQVETYSINKEEISLKELDFKLRKHLIDKHDLYKTEPKDSKIRVTMKNGDFYTFELNEKLQTHRMGDVIDGRNIEKIEVNL

SEQ ID NO: 35316 - protein, 227 aa, Staphylococcus aureus; identical to SEQ ID NO: 31159
  subsp. aureus 21331

SEQ ID NO: 35317 - protein, 232 aa, Staphylococcus aureus; identical to SEQ ID NO: 31158
  subsp. aureus 21331

SEQ ID NO: 35318 - protein, 231 aa, Staphylococcus aureus; identical to SEQ ID NO: 31157
  subsp. aureus 21331

SEQ ID NO: 35319 - protein, 234 aa, Staphylococcus aureus; identical to SEQ ID NO: 31156
  subsp. aureus 21331

SEQ ID NO: 35320 - protein, 317 aa, Staphylococcus aureus; identical to SEQ ID NO: 31155
  subsp. aureus 21331

SEQ ID NO: 35321 - protein, 343 aa, Staphylococcus aureus; identical to SEQ ID NO: 31154
  subsp. aureus 21331

SEQ ID NO: 35322 - protein, 233 aa, Staphylococcus aureus
  subsp. aureus 21331
MKMKSIAKVSLVLGILATGVNTVTEQPVHAENKHVQVSQNSKNLKAYYTQPSVEYKNVTGYISSIQPKPGTKFLNMIEGNTVNNLALVGKDKEHYHTGVHRNLDIFYVNEDKRFEGAKYSIGGITKASDKVVDQVAEARVIKEDHTGEYAYDFFPFKIDKEAMTLKEVDFKIRKHLIDHYGLYGEMSSGTVTVQMKYYGKYTIELDKKLQEDRMADIVKAIDIDRIEVKVKKA

SEQ ID NO: 35323 - protein, 226 aa, Staphylococcus aureus; identical to SEQ ID NO: 31152
  subsp. aureus 21331

SEQ ID NO: 35324 - protein, 55 aa, Staphylococcus aureus; identical to SEQ ID NO: 31151
  subsp. aureus 21331

SEQ ID NO: 35325 - protein, 691 aa, Staphylococcus aureus
  subsp. aureus 21331
MLRGQEERKYSIRKYSIGVVSVLAATMFIVSSHEAQASEKTPTSNAAAQKETLNQPGEQGNAVTSHQMQSGKQLDDMHKENGKSGTVTEGKDTLQSSKHQSTQNSKTSRTQNDNQVKQDSERQGSKQSHPNNATNKTERQNDQVQNTHHAERNESQSTTSQSNDVDKSQPSVPAQKVIPNHDKAAPTSTTLPSNDKTAPKSTKAQDASTDKHPNQQDTHQPAHQIIDAKQDDNVHQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHQAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNNEPATRRGIWQVKPILQGWDHVDFIGVDFLDFKRKGAELANFYTGIINDLLRVEATEGKGTQLKAS

SEQ ID NO: 35326 - protein, 928 aa, Staphylococcus aureus
  subsp. aureus 21331
MIVVGMGQEKEAAASEQNNTTVEESGNSATESKASETQTTTNNVNTIDETQSYSATSTEQPSQSTQVTTEEAPTTVQAPKAETSRVDLPSEKAADKGIVGTQVDTTQPSNVSEIKPRMKRSADVTAASEKEVVEEAKVTGTDVTSKVKVEEGSEIVGHNNKETNVVNPHNAERVTLKYKWKFEDGIKPGDYFDFTLSNNVETHGISPLRKVPDIKSKDGQVMAVGEVNEERKIRYTFKEYVQGKKDLKAELDLNLFIDPTTVTKRGNQNIEVTLGEKKISKQFDIKYLDGVKDNWGVTVNGRIHTLNKQEGRFSHFAYVKPNNQSLTSVTVTGQVTSGYKQNAKNPTVKVYKHIGSDELAESVYGDVLDETKFEDVTDKLSLTLTGNGGYTLDFSELDKTKNYVIKYEGDYNSSASDLNFQTKLSGYHNYYYSYYPVQLTWNNGVAFYSNNAQGDGKDKPKEPIIEHSTPIELEFKSEPPMEKHELTGTVEESDDSKPIDFEYHTAVEGAEGHAEGTIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPGEPTPPTPEVPSEPETPVPPTPEVPSEPGKPVPPAKEEPKKPSKPVEQGKVVTPVIEINEKVKAVAPTKQKQSKKSELPETGGEESTNKGILFGGLFSILGLALLRRNKKNHKA

SEQ ID NO: 35327 - protein, 233 aa, Staphylococcus aureus; identical to SEQ ID NO: 31195
  subsp. aureus 21331

SEQ ID NO: 35328 - protein, 314 aa, Staphylococcus aureus
  subsp. aureus 21331
PDPDPDSDSDSDSGSDSDSDSDSDSDSDSDSDSDSDSESDSDSDSESDSESDSDSDSDSDSDSDSDSDSDSDSNSDSESDSDSDSDSDSDSDSDSDSDSDSDSDSDSDSDSDSGSDSDSDSDSDSDSDSDSDLDSDSDSESDSDSDSDSDSDSDSESDSDSDLDSDSDSDSDSDSDSDSDSDSDSDSDSDSESDSDSDSDSDSDSDSDSESDSDSDSDSDSDSDSDSDSDSDSDSDSDSDSRVTPPNNEQKAPSNPKGEVNHSNKASKQHQTDALPETGDKSENTNATLFGAMMALLGSLLLFRKRKQDHKEKA

SEQ ID NO: 35329 - protein, 162 aa, Staphylococcus aureus
  subsp. aureus 21333
HTEIIEEDTNKDKPSYQFGGHNSVDFEEDTLPKVSGQNEGQQTIEEDTTPPTPPTPEVPSEPETPTPPTPEVPAEPGKPVPPAKEEPKKPSKPVEQGKVVTPVIEINEKVKAVAPTKKAQSKKSELPETGGEEPTNKGMLFGGLFSILGLALLRRNKKNHKA

SEQ ID NO: 35330 - protein, 372 aa, Staphylococcus aureus; identical to SEQ ID NO: 33615
  subsp. aureus 21333

SEQ ID NO: 35331 - protein, 896 aa, Staphylococcus aureus; identical to SEQ ID NO: 33578
  subsp. aureus 21333

SEQ ID NO: 35332 - protein, 2186 aa, Staphylococcus aureus; identical to SEQ ID NO: 33583
  subsp. aureus 21333

SEQ ID NO: 35333 - protein, 331 aa, Staphylococcus aureus; identical to SEQ ID NO: 31305
  subsp. aureus 21333

SEQ ID NO: 35334 - protein, 327 aa, Staphylococcus aureus; identical to SEQ ID NO: 30538
  subsp. aureus 21333

SEQ ID NO: 35335 - protein, 311 aa, Staphylococcus aureus; identical to SEQ ID NO: 30617
  subsp. aureus 21333

SEQ ID NO: 35336 - protein, 685 aa, Staphylococcus aureus
  subsp. aureus 21333
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANLETVKEEVVKEEAKPQVKETTQSQDNSGDQRQVDLTPKKATQNQVAEIQVEVAQPRTVSESKPRVTRSADVVDAKEAKVETGTDVTSKVTVTESSIEGHNNTNKVEPHAGQRAVLKYKLKFEDGLKKGDYFDFTLSNNVNTYGVSTARKLPEIKNGSVVMATGQLLGDGKIRYTFTDYIDYKVNVTANLNLNLFIDPRIVKNNGEETLTSKLNGKNTEKKIEVEYKDGIGKYYTNLNGSIETFNKADNKFTHVAYVKPINGNKSESVSITGSLTQGSNVSGDSPIVKVYEYQGKETDLPKSVSVNLTDNSKFKDVTSDMQNKLTVQENGNYQLNLEKLDKTYVIHYTGEYSKETDEVNFRTQVSAYPENSYRYYSYYNNHYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEEFTHENSKHHADVVEYEEDTNPGGGQVTTESNLVEFDEESTKGIVTGAVSDHTTVEDTKEYTTESNLIELVD

SEQ ID NO: 35337 - protein, 221 aa, Staphylococcus aureus; identical to SEQ ID NO: 33608
  subsp. aureus 21333

SEQ ID NO: 35338 - protein, 2466 aa, Staphylococcus aureus
  subsp. aureus 21333
MNLFRQQKFSIRKFNVGIFSALIATVTFISTNPTTASAAEQNQPAQNQPAQPADANAQPNANAGAQANPAAQPAAGTAQPAGQGNQADPNNAAQAQPGNQAAPANQAGQGNNQATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKQAAYTELDTKKQEARTNLDAANTNSAVTTAKDNGIAAINQVQAATTKKSDAKAEIAQKASERKTAIEAMNDSTTEEQQAAKEKVDQAVLSANADIDNAAANTDVDNAKTTNEATIAAITPDANVKPQAKQAIADKVQAQEKAIDANNGSTTEEKAAAKQQVQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKAIQAIAAATTNAQVDEAKTNAEAAINAVTPKVVKKQTAKDEIDQLQATQTNVINNDQNATTEEKEAAIQQLATAVTDAKNNITAATDDNGVDQAKDAGKNSIQSTQPATSVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVSSKPEVESTNNGTTDKPVTETDNATPAESTTNNNSTTTATNENAPTGSTTTAPTTASTEAASSADSKDNASVNDSKQNAEVNNSAESQSTNGKVAQPKSENKAKAEKDGRDSTNQSMVESTTETLPSADITEPNVPSNTSKDKEESTSNQTDAGQLKSETNVASNEADKSPSKADTEVSNKPSTSASSEAKEKMTSTNVSQKDDTATADTNDMQTSVGSVANNKAKDMQTNDTQTSVGPVANNKATQNDGANASPATVSNGSHSMHQDMLNVTKTEENKANAKSDQQGKVNKPKQQAKTLPDTGMSHNDDLPYAELALGAGMAFLIRRFTKKDQQTEE

SEQ ID NO: 35339 - protein, 231 aa, Staphylococcus aureus; identical to SEQ ID NO: 33623
  subsp. aureus 21333

SEQ ID NO: 35340 - protein, 96 aa, Staphylococcus aureus; identical to SEQ ID NO: 30813
  subsp. aureus 21333

SEQ ID NO: 35341 - protein, 325 aa, Staphylococcus aureus; identical to SEQ ID NO: 30484
  subsp. aureus 21333

SEQ ID NO: 35342 - protein, 312 aa, Staphylococcus aureus; identical to SEQ ID NO: 30391
  subsp. aureus 21333

SEQ ID NO: 35343 - protein, 247 aa, Staphylococcus aureus; identical to SEQ ID NO: 33631
  subsp. aureus 21333

SEQ ID NO: 35344 - protein, 141 aa, Staphylococcus aureus; identical to SEQ ID NO: 30524
  subsp. aureus 21333

SEQ ID NO: 35345 - protein, 321 aa, Staphylococcus aureus
  subsp. aureus 21333
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGENFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 35346 - protein, 315 aa, Staphylococcus aureus; identical to SEQ ID NO: 30573
  subsp. aureus 21333

SEQ ID NO: 35347 - protein, 325 aa, Staphylococcus aureus; identical to SEQ ID NO: 30407
  subsp. aureus 21333

SEQ ID NO: 35348 - protein, 107 aa, Staphylococcus aureus
  subsp. aureus 21333
FGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 35349 - protein, 274 aa, Staphylococcus aureus; identical to SEQ ID NO: 33619
  subsp. aureus 21333

SEQ ID NO: 35350 - protein, 338 aa, Staphylococcus aureus; identical to SEQ ID NO: 31292
  subsp. aureus 21333

SEQ ID NO: 35351 - protein, 350 aa, Staphylococcus aureus; identical to SEQ ID NO: 33621
  subsp. aureus 21333

SEQ ID NO: 35352 - protein, 1151 aa, Staphylococcus aureus
  subsp. aureus 21333
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTNHSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 35353 - protein, 1411 aa, Staphylococcus aureus
  subsp. aureus 21333
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVSRDNNSIGSAFTETVSHAGNAEDPGYYIQTVYVNPSEKTLTNAKLKVEAYHKDYPDNVGQINKNVTKIKIYQAPKDYVLNKGYDVNTNQLIDVTEQFKDKITYGTNDSVNVDFGSINNSYVVMVDTKFEFTTSESPTLVQMATLTSDGNRSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGNDTEKDSNGLTTTGVINGDDNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 35354 - protein, 959 aa, Staphylococcus aureus
  subsp. aureus 21333
MNNKKTATNRKGMIPNRLNKFSIRKYSVGTASILVGTTLIFGLSGHEAKAAEHTNGELNQSKNETTGTSENKTTEKVDSRQLKDNTQTATADQPKVTMSDSATVKETSSNMQSPQNATANQSTTQTSNVTTNDKSATTYSNDTSKSNLTQAKDVSTKPKTTTIKPRTLNRMAVNTVAAPQQGTNVNDKVHFKNIDIAIDKGHVNKDTGKTEFWATSSDVLKLKANYTIDDSVKEGDTFTFKYGQYFRPGSVRLPSKTQNLYNAQGNIIAKGIYDSATNSTTYTFTNYVDQYTNISGSIEQVSFAKRENATTDKTAYKMEVTLGNDSYSKEVIVDYGNKKAQPLISSTNYINNEDLSRNMTAYVNQPKNTYTKQTFVTNLTGYKFNPNAKNFKIYEVTNQNQFVDSFTPDTSKLTDVTDQFDINYSNDNKTATVDLMKGQKSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAIDSDGLTTTGVIKDADNMTLDSGFYKTPKYSLGDYVWYDSNKDGKQDSTEKGIKGVKVTLQNEKGEVIGTTETDSNGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSYSDSDSDSDSDSDSDSDSDSDSDSDSDSDSDSDNDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 35355 - protein, 809 aa, Staphylococcus aureus; identical to SEQ ID NO: 33630
  subsp. aureus 21333

SEQ ID NO: 35356 - protein, 232 aa, Staphylococcus aureus; identical to SEQ ID NO: 33597
  subsp. aureus 21333

SEQ ID NO: 35357 - protein, 691 aa, Staphylococcus aureus; identical to SEQ ID NO: 33577
  subsp. aureus 21333

SEQ ID NO: 35358 - protein, 227 aa, Staphylococcus aureus; identical to SEQ ID NO: 30585
  subsp. aureus 21333

SEQ ID NO: 35359 - protein, 232 aa, Staphylococcus aureus; identical to SEQ ID NO: 31335
  subsp. aureus 21333

SEQ ID NO: 35360 - protein, 232 aa, Staphylococcus aureus; identical to SEQ ID NO: 33594
  subsp. aureus 21333

SEQ ID NO: 35361 - protein, 231 aa, Staphylococcus aureus; identical to SEQ ID NO: 33593
  subsp. aureus 21333

SEQ ID NO: 35362 - protein, 234 aa, Staphylococcus aureus; identical to SEQ ID NO: 33390
  subsp. aureus 21333

SEQ ID NO: 35363 - protein, 279 aa, Staphylococcus aureus; identical to SEQ ID NO: 33591
  subsp. aureus 21333

SEQ ID NO: 35364 - protein, 356 aa, Staphylococcus aureus; identical to SEQ ID NO: 33590
  subsp. aureus 21333

SEQ ID NO: 35365 - protein, 231 aa, Staphylococcus aureus; identical to SEQ ID NO: 33589
  subsp. aureus 21333

SEQ ID NO: 35366 - protein, 226 aa, Staphylococcus aureus; identical to SEQ ID NO: 33588
  subsp. aureus 21333

SEQ ID NO: 35367 - protein, 203 aa, Staphylococcus aureus; identical to SEQ ID NO: 33582
  subsp. aureus 21333

SEQ ID NO: 35368 - protein, 233 aa, Staphylococcus aureus; identical to SEQ ID NO: 33414
  subsp. aureus 21333

SEQ ID NO: 35369 - protein, 198 aa, Staphylococcus aureus; identical to SEQ ID NO: 31544
  subsp. aureus 21333

SEQ ID NO: 35370 - protein, 865 aa, Staphylococcus aureus; identical to SEQ ID NO: 33611
  subsp. aureus 21333

SEQ ID NO: 35371 - protein, 2189 aa, Staphylococcus aureus; identical to SEQ ID NO: 33617
  subsp. aureus 21333

SEQ ID NO: 35372 - protein, 681 aa, Staphylococcus aureus; identical to SEQ ID NO: 33618
  subsp. aureus 21333

SEQ ID NO: 35373 - protein, 508 aa, Staphylococcus aureus
  subsp. aureus 21333
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKVWEANISDLGLDKSEAYNFLITSSQRQGTSQGVYANGWMRTDLNNSTFKLTPNLVKKTEIKTVEIPFETKREFNPKLQPGEERVKQEGQPGSKTITTPITVNPLTGEKVGEGQPTEEITKQPVDKIVEFGGEKIPQGHKG

SEQ ID NO: 35374 - protein, 194 aa, Staphylococcus aureus
  subsp. aureus 21333
YTEIIEEDTNKDKPNYQFGGHNSVDFEEDTLPQVSGQNEGQQTIEEDTTPPIVPPTPPTPEVPSEPETPTPPTPEVPSEPETPTPSTPEVPSEPEVPTPPTPEVPTEPGKPVPPAKEEPKKPSKPVEQGKVVTPVIEINEKVKAVAPTKQKQPKKTELPETGGEESTNKGMLFGGLFSILGLALLRRNKKNHKA

SEQ ID NO: 35375 - protein, 970 aa, Staphylococcus aureus; identical to SEQ ID NO: 33633
  subsp. aureus 21333

SEQ ID NO: 35376 - protein, 434 aa, Staphylococcus aureus [sequence omitted]

SEQ ID NO: 35377 - protein, 240 aa, Staphylococcus aureus; identical to SEQ ID NO: 33628
  subsp. aureus 21333

SEQ ID NO: 35378 - protein, 484 aa, Staphylococcus aureus; identical to SEQ ID NO: 33627
  subsp. aureus 21333

SEQ ID NO: 35379 - protein, 47 aa, Staphylococcus aureus
  subsp. aureus 21333
MKTPRDYSFDIYDLKGENDYEIDKIYEDNKTLKSEDISHIDIYLYTK

SEQ ID NO: 35380 - protein, 168 aa, Staphylococcus aureus
  subsp. aureus 21333
MFVLTSYAKAEDLHDKSELSDLALANAYGQYNHPFIKENVISSEIIGEKDLIFRNQGDNGNDLRVKFASAGLAQNFKNKNVDIYGASFYYKCEKVSENISECLYGGTTLNNEKLEQERVIGANVWVNGIQKETELIRTNKKNVTLQELDIKMRKNYLINIEFIIKTVK

SEQ ID NO: 35381 - protein, 250 aa, Staphylococcus aureus; identical to SEQ ID NO: 33634
  subsp. aureus 21333

SEQ ID NO: 35382 - protein, 291 aa, Staphylococcus aureus; identical to SEQ ID NO: 30390
  subsp. aureus 21333

SEQ ID NO: 35383 - protein, 241 aa, Staphylococcus aureus; identical to SEQ ID NO: 33607
  subsp. aureus 21333

SEQ ID NO: 35384 - protein, 241 aa, Staphylococcus aureus; identical to SEQ ID NO: 30739
  subsp. aureus 21333

SEQ ID NO: 35385 - protein, 238 aa, Staphylococcus aureus; identical to SEQ ID NO: 30740
  subsp. aureus 21333

SEQ ID NO: 35386 - protein, 319 aa, Staphylococcus aureus; identical to SEQ ID NO: 30605
  subsp. aureus 21333

SEQ ID NO: 35387 - protein, 165 aa, Staphylococcus aureus; identical to SEQ ID NO: 33603
  subsp. aureus 21333

SEQ ID NO: 35388 - protein, 105 aa, Staphylococcus aureus; identical to SEQ ID NO: 33600
  subsp. aureus 21333

SEQ ID NO: 35389 - protein, 350 aa, Staphylococcus aureus; identical to SEQ ID NO: 30602
  subsp. aureus 21333

SEQ ID NO: 35390 - protein, 647 aa, Staphylococcus aureus; identical to SEQ ID NO: 33598
  subsp. aureus 21333

SEQ ID NO: 35391 - protein, 273 aa, Staphylococcus aureus
  subsp. aureus 21334
YPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 35392 - protein, 338 aa, Staphylococcus aureus
  subsp. aureus 21334
MIKQLYKNITICSLAISTALTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAYLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHNVKFVKVLNDNEKK

SEQ ID NO: 35393 - protein, 351 aa, Staphylococcus aureus
  subsp. aureus 21334
MKNKKRVLIASSLSCAILLLSAATTQANSAHKDSQDQNKKEHVDKSQQKEKRNVTNKDNNSTAPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 35394 - protein, 886 aa, Staphylococcus aureus
  subsp. aureus 21334
MKNNLRYGIRKHKLGAASVFLGTMIVVGMGQDKEAAASEQKTTTVEENGNSATDNKVNETQTTTTNVNTIDETQSYSATATEQPSNATQVTTEKAPKAVQAVQAPQTAQPANLETVKEEVVKEEAKPQVKETTQSQDNSGDQRQVDLTPKKATQNQVAETQVEVAQPRTVSESKPRVTRSADVVDAKEASDVSEVKGTDVTSKVTVEDESKIEAPKGNNVQPHEGQRVVLKYKLKFQDGLKTGDYFDFTLSNNVNTHGVSTIRKVPDIKNGSLVMAKGQVLDNGRIRYTFIDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGTENGLPQSVYANTADSTQLKDVTNQMSDKLKVQNNGSYSLNFDKLDKTYVIHYTGDYLNGTSEVNFRTQLTGYPENRYKTYYYNNGYILTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTRVIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNIVDFEEDTLPKVSGQNEGQQTIEEDTTPPTPPTPE

SEQ ID NO: 35395 - protein, 221 aa, Staphylococcus aureus
  subsp. aureus 21334
MKAKLWFLLTTLAFLIAVTGSIGIAEVKAKTTGLITENSNDSLKEHYAQKFEVYTNKEVTGVGENYIDVKVDTYNVRTVLYNTDYLKQFKNQDKVNIWGTLYENQQSKVYRGTVVKYDPISKVTNLSYRMNLFVNGHQTKVNPDSLLEVKNKQISLKETDFRIRKYLLEKEHLYSNYNSGELIIEMKNGARHKIDLGDILSDSQEKTFDFDNISHIDIYMK

SEQ ID NO: 35396 - protein, 233 aa, Staphylococcus aureus
  subsp. aureus 21334
MKKTIMASSLAVALGVTGYAASTGHEAHAAEVNVDQAHLVDLAHNHQDQLNAAPIKDGAYDIHFVKDGFQYNFTSNGTTWSWSYEAANGQTTGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 35397 - protein, 211 aa, Staphylococcus aureus; identical to SEQ ID NO: 30592
  subsp. aureus 21334

SEQ ID NO: 35398 - protein, 805 aa, Staphylococcus aureus
  subsp. aureus 21334
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSDSDSDSDSDSDSDSDSDSDSDSESDSDSDSDSDSDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 35399 - protein, 2221 aa, Staphylococcus aureus
  subsp. aureus 21334
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSESSSTSQSLSDSTSNAISTSESLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSLSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDSSSTSLSDSTSASMQSSESDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSLSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSVSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 35400 - protein, 681 aa, Staphylococcus aureus; identical to SEQ ID NO: 34632
  subsp. aureus 21334

SEQ ID NO: 35401 - protein, 240 aa, Staphylococcus aureus
  subsp. aureus 21334
HLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35402 - protein, 109 aa, Staphylococcus aureus; identical to SEQ ID NO: 33345
  subsp. aureus 21334

SEQ ID NO: 35403 - protein, 165 aa, Staphylococcus aureus; identical to SEQ ID NO: 30418
  subsp. aureus 21334

SEQ ID NO: 35404 - protein, 319 aa, Staphylococcus aureus; identical to SEQ ID NO: 30605
  subsp. aureus 21334

SEQ ID NO: 35405 - protein, 238 aa, Staphylococcus aureus; identical to SEQ ID NO: 30740
  subsp. aureus 21334

SEQ ID NO: 35406 - protein, 241 aa, Staphylococcus aureus; identical to SEQ ID NO: 30739
  subsp. aureus 21334

SEQ ID NO: 35407 - protein, 241 aa, Staphylococcus aureus
  subsp. aureus 21334
MKKNIMNKLVLSTALLLLGTTSTQLPKTPISFSSEAKAYNISENETNINELIKYYTQPHLSLSNKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYMIDLSKKLKLTDTNRYVKNPRNAEIEVILEKSN

SEQ ID NO: 35408 - protein, 641 aa, Staphylococcus aureus; identical to SEQ ID NO: 33886
  subsp. aureus 21334

SEQ ID NO: 35409 - protein, 350 aa, Staphylococcus aureus; identical to SEQ ID NO: 33885
  subsp. aureus 21334

SEQ ID NO: 35410 - protein, 773 aa, Staphylococcus aureus
  subsp. aureus 21334
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSD

SEQ ID NO: 35411 - protein, 96 aa, Staphylococcus aureus; identical to SEQ ID NO: 30813
  subsp. aureus 21334

SEQ ID NO: 35412 - protein, 895 aa, Staphylococcus aureus; identical to SEQ ID NO: 30734
  subsp. aureus 21334

SEQ ID NO: 35413 - protein, 100 aa, Staphylococcus aureus
  subsp. aureus 21334
ETPTPPTPEVPSEPETPTPPAKEEPKKPSKPVEQGKVVTPVIEINEKVKAVAPTKQKQSKKSELPETGGEESTNKGMLFGGLFSILGLALLRRNKKNHKA

SEQ ID NO: 35414 - protein, 325 aa, Staphylococcus aureus; identical to SEQ ID NO: 30407
  subsp. aureus 21334

SEQ ID NO: 35415 - protein, 315 aa, Staphylococcus aureus; identical to SEQ ID NO: 30573
  subsp. aureus 21334

SEQ ID NO: 35416 - protein, 321 aa, Staphylococcus aureus; identical to SEQ ID NO: 30959
  subsp. aureus 21334

SEQ ID NO: 35417 - protein, 62 aa, Staphylococcus aureus; identical to SEQ ID NO: 30610
  subsp. aureus 21334

SEQ ID NO: 35418 - protein, 138 aa, Staphylococcus aureus; identical to SEQ ID NO: 34023
  subsp. aureus 21334

SEQ ID NO: 35419 - protein, 226 aa, Staphylococcus aureus
  subsp. aureus 21334
MKFKAIAKASLALGMLATGVITSNVQSVQAKTEAKQQSESELKHYYNKPFFERKNVTGYGFTDKGQHYLEVTVGQQHSLITLLGSDKDKYNKDVNPNLDVFVVREGDSRQATNYSIGGVTKTNSGQYYDYVNVTLLEVKNRNKDPQSSIYYIPKEDISLKELDFKLRKQLISQSGLYSNGLKQGQITITMNDGTTHTIDLSQKLEKERMGESIDGRQIQKILVEMK

SEQ ID NO: 35420 - protein, 231 aa, Staphylococcus aureus
  subsp. aureus 21334
MKMKSIAKISLLLGLLATGVSTTTEKPVHAEKKPIVISENSKKLNAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 35421 - protein, 356 aa, Staphylococcus aureus
  subsp. aureus 21334
MKMRTIAKTSLALGILTTGAITVTTQSVKAEKVQSTKVDKVSTLKAERLAMINITAGANTVTTQAAKTGQERTPKLEKAPNTNEEKTSTSKIEKVSQPKQEAQKLLNISATPAPKQEQSQTTTESTTPKTKVTTPSSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELSVTKKDNQGMISHDVSEYMITKEEISLKELDFKLRKQLIEKHNLYGNMGSGTIVIKMKNGGKYTFELHKKLQEHRMADVIKGTNIDKIEVNIK

SEQ ID NO: 35422 - protein, 264 aa, Staphylococcus aureus
  subsp. aureus 21334
MKITTIAKTSLALGLLTTGVITTTTQAANATTPSSTKVEAPQSKPNATTPPSSNVDTSPPQSPTTKQVPTEINPKFKDLRAYYTKPSLEFKSEIGIILKKWTTIRFMNVVPDYFIYKIALVGKDDNKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 35423 - protein, 234 aa, Staphylococcus aureus
  subsp. aureus 21334
MKMTAIAKASLALGILATGTITSLHQTVNASEHKAKYENVTKDIFDLRDYYSGASKELKNVTGYRYSKGGKHYLIFDKNRKFTRVQIFDKDIERFKARKNPGLDIFVVKEAENRNGTVFSYGGVTKKNQGAYYDYLNAPRFVIKKEVDAGVYTHVKRLYIYKEEISLKELDFKLRQYLIQNFDLYKKFPKDSKIKVIMKDGGYYTFELNKKLQTNRMSDVIDGRNIEKIEANIR

SEQ ID NO: 35424 - protein, 231 aa, Staphylococcus aureus; identical to SEQ ID NO: 31761
  subsp. aureus 21334

SEQ ID NO: 35425 - protein, 231 aa, Staphylococcus aureus
  subsp. aureus 21334
MKLKTLAKATLALGLLTTGVITSEGQAVQAKEKQERVQHLYDIKDLHRYYSSESFEFSNISGKVENYNGSNVVRFNQENQNHQLFLLGKDKDKYKEGLEGQNVFVVKELIDPNGRLSTVGGVTKKNNQSSETNTPLFIKKVYGGNLDASIESFLINKEEVSLKELDFKIRQHLVKNYGLYKGTTKYGKITFNLKDGEKQEIDLGDKLQFEHMGDVLNSKDIQNIAVTINQI

SEQ ID NO: 35426 - protein, 232 aa, Staphylococcus aureus
  subsp. aureus 21334
MKFTAIAKAIFVLGILTTSAMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGAADKGRIVINMKDENKYEIDLSDKLDFERMADVINSEQIKNIEVNLK

SEQ ID NO: 35427 - protein, 690 aa, Staphylococcus aureus
  subsp. aureus 21334
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKAIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 35428 - protein, 232 aa, Staphylococcus aureus
  subsp. aureus 21334
MKFTELAKATLALGILTTGVFTAESKAVHAKVELDETQRKYYINMLHQYYSEESFESTNISVKSEDYYGSNVLNFKQRNKTFKVFLLGDDKNKYKEKTHGLDVFAVPELIDIKGGIYSVGGITKKNVRSVFGFVINPSLQVKKVDAKHGFSINELFFIQKEEVSLKELDFKIRKMLVEKYSLYKGASDKGRIVINMKDEKKYVIDLSEKLSFDRMFDVMDSKQIKNIEVNLN

SEQ ID NO: 35429 - protein, 227 aa, Staphylococcus aureus; identical to SEQ ID NO: 30585
  subsp. aureus 21334

SEQ ID NO: 35430 - protein, 231 aa, Staphylococcus aureus
  subsp. aureus 21334
MKLKNIAKASLALGILTTGMITTTAQPVKASEQSRLSVTSKDTQELKSYYSGTGFNFQNVSGYREENKMNVIVGQQLNVISLLGSDKERFDDGKDYNNLDVFVVREGSGKQADNISIGGITKTNENKYKDTVKHVNMFIYRNTSHNTTTVKSTFHNIYKEEISLKELDFKLRKQLIDNHDLYKTEPKDSKIKVTMENGDYYTFELNKKLQEHRMGDVIDGTKIKEINVELN

SEQ ID NO: 35431 - protein, 203 aa, Staphylococcus aureus
  subsp. aureus 21334
MFKKHHSKNSILLKSILSLGIIYSGSFGIYSKANASTQNSSSVHDKQLQKVEEVPNNSEKALVKKLYDRYSKNTINGKSNKSRNWVYSERPLNGNQVRIHLEGTYTVAGRVYTPKRNITLNKEVVTLKELDHIIRFAHISYGLYMGEHLPKGNIVINTKNGGKYTLESHKELQKDRENVKINTDDIKNVTFELVKSVNDIEQV

SEQ ID NO: 35432 - protein, 434 aa, Staphylococcus aureus [sequence omitted]

SEQ ID NO: 35433 - protein, 927 aa, Staphylococcus aureus
  subsp. aureus 21334
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGDTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSASDSDSDSDSDSSSDSDSESDSNSDSESGSNNNVVPPNSPKNGTNASNKNEAKDSKEPLPDTGSEGEANSSLIWGLLASLGSLLLFRRKKENKDKK

SEQ ID NO: 35434 - protein, 121 aa, Staphylococcus aureus
  subsp. aureus 21334
DSDSDSDRDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 35435 - protein, 1315 aa, Staphylococcus aureus
  subsp. aureus 21334
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNAETLVDNNSNSNNENNADIILPKSTAPKRLNTRMRMAAIQPNSTDSKNVNNLITSTTTLTVVDADKNNKIVPAQDYLTLKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVSRDNNSIGSAFTETVSHAGNAEDPGYYIQTVYVNPSEKTLTNAKLKVEAYHKDYPDNVGQINKNVTKIKIYQAPKDYVLNKGYDVNTNQLIDVTEQFKDKITYGTNDSVNVDFGSINNSYVVMVDTKFEFTTSESPTLVQMATLTSDGNRSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 35436 - protein, 258 aa, Staphylococcus aureus; identical to SEQ ID NO: 34610
  subsp. aureus 21334

SEQ ID NO: 35437 - protein, 251 aa, Staphylococcus aureus; identical to SEQ ID NO: 33835
  subsp. aureus 21334

SEQ ID NO: 35438 - protein, 238 aa, Staphylococcus aureus; identical to SEQ ID NO: 33836
  subsp. aureus 21334

SEQ ID NO: 35439 - protein, 242 aa, Staphylococcus aureus; identical to SEQ ID NO: 30399
  subsp. aureus 21334

SEQ ID NO: 35440 - protein, 239 aa, Staphylococcus aureus; identical to SEQ ID NO: 30622
  subsp. aureus 21334

SEQ ID NO: 35441 - protein, 254 aa, Staphylococcus aureus; identical to SEQ ID NO: 33839
  subsp. aureus 21334

SEQ ID NO: 35442 - protein, 453 aa, Staphylococcus aureus
  subsp. aureus 21334
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSADAKNYQAQGNVIALGRIKGNDTNDHGDFNGIEKTLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTT

SEQ ID NO: 35443 - protein, 331 aa, Staphylococcus aureus; identical to SEQ ID NO: 31305
  subsp. aureus 21334

SEQ ID NO: 35444 - protein, 227 aa, Staphylococcus aureus
  subsp. aureus 21334
MLTNSEEAYADVGVQNLRNYYGSYEFTDLKNQSDKNNPQSHQLEYEVEGKALYSQLSSEHDVKRLKSKKVDIFGIPYTGITQNVEYIYGGITLSNDYLDNARNIPINLWINGQHKTISTDRVSTNKKQVTAQEIDVKLRRYLQEEYNIYGHNKTNKGREYGNESKFNSGFDKGNVIFHLNNGTQFSYDLFYTGHGQPEDFLKVYNDNKTIDSENFHLDVDLSLSKTI

SEQ ID NO: 35445 - protein, 250 aa, Staphylococcus aureus; identical to SEQ ID NO: 33364
  subsp. aureus 21334

SEQ ID NO: 35446 - protein, 231 aa, Staphylococcus aureus; identical to SEQ ID NO: 31073
  subsp. aureus 21334

SEQ ID NO: 35447 - protein, 2498 aa, Staphylococcus aureus
  subsp. aureus 21334
MNLFRQQKFSIRKFNVGIFSALIATVTFISTNPTTASAAEQNQPAQNQPAQPADANTQPNANAGAQANPAAQPAAPANQGQPAAQPAAQPANQGGQANPAGGAAQPAGQGNQADPNNAAQAQPGNQAAPANQAGQGNNQATPNNNATPANQTQPANAPAAVQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADCLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNAAANADVDNAKTTNEATIAAITPDANVKPAAKQAIADKVQAKETAIDANNGSTTEEKEAAKQQVQTEKTAADAAIDAAHSNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYLDILNAQTTNDVTQIKDQAVTDIQGITADTTIKDVAKDELATKANEQKALIAQTADATTEEKEQANQQVDAQLTQGNQNIENAQSIDDVNTAKENAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQTSVGPVANNKAKDMQTNDTQKSVGSAANNKATQNDGANASPATVSNGSNSANQDMLNVTKPEENKANAKSAQQGKVNKAKQQAKTLPDTGMSHNDDLPYAELALGAGMAFLIRRFTKKDQQTEE

SEQ ID NO: 35448 - protein, 808 aa, Staphylococcus aureus
  subsp. aureus 21334
MTYRMKKWQKLSTITLLMAGVITFNDSEFRSVDKHQIAVADTNVQTTDYEKLRNTWLNVNYGYDKYDESNQDMKKKFEATKNEAKKLLSEMKTESGRTYLWENAKDLDNKSADMTRTYRNIEKIAEAMKHPKTTLNTDQNKNKVKDALEWLHKNAYGKEPGKKVKELSENFTKTTGKNTNLNWWDYEIGTPKSLTNTLILLKEDFTDEEKKKYTAPIKTFAPKSDEILSSVGKAEPAKGGNLVDISKVKLLESIIEEDATMMKNSIDGFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDDSTKAKYKQIVKTSVKSDSSYDSNDTLSSYSDIDKMKKLMDDSTISKNDLTQQLKIYNEMDRVTYHNKDLDFAFGLSMTSKNVARYESINNENLKGWHTGAGMSYLYNSDVKHYRDNFWATADMKRLSGTTTLDNEILKDTDDKKSSKTFVGGTKIDDQHASIGMDFENQDKTLTAKKSYFILNDKIVFLGTGIKSTDSSKNPVTTIENRKANGYTLYTDDKQTTTSNNQETNSVFLESTDTKKNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFVLKKKDDNTYECSFYNPESTNSATASDIESKISMTGYSITNKNTSTSNESGVRFELQ

SEQ ID NO: 35449 - protein, 141 aa, Staphylococcus aureus; identical to SEQ ID NO: 30633
  subsp. aureus 21334

SEQ ID NO: 35450 - protein, 105 aa, Staphylococcus aureus
  subsp. aureus 21334
MPSEPEVPTPPTPEIPSEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 35451 - protein, 291 aa, Staphylococcus aureus; identical to SEQ ID NO: 30390
  subsp. aureus 21334

SEQ ID NO: 35452 - protein, 134 aa, Staphylococcus aureus
  subsp. aureus 21334
MKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEAQRNGFIQSLKDDPS

SEQ ID NO: 35453 - protein, 339 aa, Staphylococcus aureus
  subsp. aureus 21340
TGAVSDHTTIEDTKEYTTESNLIELVDELPEEHGQAQGPIEEITENNHHISHSGLGTENGHGNYGVIEEIEENSHVDIKSELGYEGGQNIGNQSFEEDTEEDKPKYEQGGNIVDIDFDSVPQIQGQNKGDQSFEEDTEKDKPKYEQGGNLIDIDFDSVPHIHGFNKHTEIIEEDTNKDKPSYQFGGHSSVDFEESTLPQVSGQNEGQQTIEEDTTPPAPEVPSEPETPTPPAPEVPSEPETPTPPTPEVPTEPGKPVPPAKEEPKKPSKPMEQGKVVTPVIEINEKVKAVTPAKSSQPKKTELPETGGEESTNKGMLFGGLFSILGLALLRRNKKNHKA

SEQ ID NO: 35454 - protein, 325 aa, Staphylococcus aureus; identical to SEQ ID NO: 30484
  subsp. aureus 21340

SEQ ID NO: 35455 - protein, 312 aa, Staphylococcus aureus; identical to SEQ ID NO: 30391
  subsp. aureus 21340

SEQ ID NO: 35456 - protein, 681 aa, Staphylococcus aureus; identical to SEQ ID NO: 32025
  subsp. aureus 21340

SEQ ID NO: 35457 - protein, 2247 aa, Staphylococcus aureus
  subsp. aureus 21340
MSKRQKEFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSNVAGGGAFGAFVTTDSYGVATTYTSSSTADNAAKLKVQPTNNTFQNFDITYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGAGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSLSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSVSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 35458 - protein, 919 aa, Staphylococcus aureus
  subsp. aureus 21340
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNNTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIVNDKNEVVAKATYDILTKTYTFVFTDYVNDKQNINGKFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 35459 - protein, 198 aa, Staphylococcus aureus; identical to SEQ ID NO: 31544
  subsp. aureus 21340

SEQ ID NO: 35460 - protein, 233 aa, Staphylococcus aureus; identical to SEQ ID NO: 30428
  subsp. aureus 21340

SEQ ID NO: 35461 - protein, 1060 aa, Staphylococcus aureus
  subsp. aureus 21340
MGAASVFLGTMIVVGMGQDKEAAASEQNTTVEENGNSATENKSKQTTTNNVNNIDETQTYSATSTEQPSNATQVTAEAAPQAVEAPQTSQAPQKVQSTNVETVKEEVVKEEVQPQVKETARSQENSGDQRQVDLTPKKVTQNQGTEPQVEVAQPRTVSESKPRVTRSTDVAEAKDASEIKGTDVTSKVTVESGSIEAPQGNKVEPHAGQRVVLKYKLKFEKGLHKDDYFDFTLSNNVNTHGVSTARKVPDIKNGTVVMATGQLLGNGKIRYTFTDYIDYKVNVTADLEINLFIDPKTVQSNGQQIITSTLNDKETRTTLPIQYNPGVSNSYANVNGSIETFDKGNNKFTHVAYIKPQNGHKSDSVSITGTLTQGSKANGNAPTVKVYEVLKDAKELPESVYANISDSTMFKDVTQEMKDKLKVENNGSYKLDIEKLEKSYVIHYDGEYLSGSDQVNFRTHMFGYPEQQYKYYYTHLGYQLTWDNGLVLYSNKAKGDGTNGTITESNNMTFDEEYGNGVITGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLLEFDEESTKGIVTGAISDHTTVEDTKEYTTESNLIELVDELPEEHGQAQGPIEEITENNQHISHSGLGTENGHGNYGIVEEIEENSHVDIKSELGYEGGQNIGNQSFEEDTEEDKPKYEQGGNIVDIDFDSVPQIQGQNKGDQSFEEDTEEDKPKYEQGGNIVDIDFDSVPQIQGQNKGNQSFEEDTEKDKPKYEHGGNIIDIDFDSVPHIHGFNKHTEIIEEDTNKDKPSYQFGGHNSVDFEEDTLPQVSGQNEGQQTIEEDTTPPIVPPTPPTPEVPSEPETPTPPTPEVPSEPETPTPTPPTPEVPSEPETPTPPTPEVPSEPETPTPPMPEIPAEPGKPVPPANEEPKKPSKPVEQGKVVTPVIEINEKVKAVKPAKTSQSKKTELPETGGEETTNNGVLFGGLLSIIGLVLLRRNKKNHKA

SEQ ID NO: 35462 - protein, 652 aa, Staphylococcus aureus
  subsp. aureus 21340
MKNNLRYGIRKHKLGAASVFLGTMIVVGMGQDKEAAASEQNTTVEESGSSATESKASETQTTTNNVNTIDETQSYSATSTEQPSKSTQVTTEEAPKTVQAPKVETSRVDLPSVKVADKETTGTQVDTTQPSNVSEIKPRMKRSVDVAEVAEKEVVGEAKATGTDVTSKVTVEDGSEIVGHNNKETNVVNPHNAERVTLKYKWKFGEGIKAGDYFDFTLSDNVETHGISTLRKVPEIKSSTEDKVMANGQVINERTIRYTFTDYINSKKNLTAELNLNLFIDPTTVTKQGKQNVKVTLANKVIEQEFDIKYLDGVKDRMGVTVNGRIDTLNKEGGKFSHFAYVKPNNQSLTSVTVTGQVTSGYKQNANKPTVKVYKHIGSDELAESVYAKLDDVNKFEDVTNKVNLSYTGDGGYSLDFSDLDNSKDYVIKYEGEYDQNAKDLNFRTHLSGYHKNYPYYPNYYYPVQLTWNNGVAFYSNNAQGDGKDKPNDPIIEKSEPIDLDIKSEPPVEKHELIGTIEESSDSKPIDFEYHTTVEGAEGHAEGIVETEEDSIHVDFEESTHKNSKHHADVVEYEEDTNPGGGQVTTESNLVEFDEDSTKGIVTGAVSDHTTIEDTKEYTTESNLIELVDELPEEHGQAQGPIEEITENNHHI

SEQ ID NO: 35463 - protein, 1165 aa, Staphylococcus aureus
  subsp. aureus 21340
MINRDNKKAITKKGMISNRLNKFSIRKYTVGTASILVGTTLIFGLGNQEAKAAENTSTENAKQDDATTSDNKEVVSETENNSTTENNSTNPIKKETNTDPQPEAKEESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTNRSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDAKGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 35464 - protein, 1344 aa, Staphylococcus aureus
  subsp. aureus 21340
MLNRENKTAITRKGMVSNRLNKFSIRKYTVGTASILVGTTLIFGLGNQEAKAAEVTNKEMKEDATSVNNDQVSKKVDTEQLNNDSNTRKVDREQLKDENINKVANQKEVTRVENSVASEKNNNSQPSENGKLQTSDVKKTEDNNATSDDQVTTTVNSQQLNTDNTTSNATMSSAPINVSKDDLKINSEVVKNVVENSDNTDNANGSDVILPKSTAPKRLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 35465 - protein, 950 aa, Staphylococcus aureus
  subsp. aureus 21340
MNNKKTATNRKGMIPNRLNKFSIRKYSVGTASILVGTTLIFGLSGHEAKAAEHTNGELNQSKNETTAPSENKTTEKVDSRQQNNIEQSTTVKETSSNMQSPQNTTANQSTTQTSNVTTNDKSSTTYSNETDKSNLTQAKDVSTTPKTTTIKPRTLNRMAVNTVAAPQQGTNVNDKVHFTNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTVYKMEVSLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDNDSDSDSDSDAGKHTPAKPMSTVKDQHKTAKALPETGSENNNSNNGTLFGGLFAALGSLLLFGRRKKQNK

SEQ ID NO: 35466 - protein, 922 aa, Staphylococcus aureus
  subsp. aureus 21340
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPLTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKNDVKATLTVPAYIDPENVTKTGNVTLTTGIGTNTASKTVLIDYEKYGQFHNLSIKGTIDQIDKTNNTYRQTIYVNPSGDNVVLPVLTGNLIPKSNSNALIDANNTNIKVYKVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDLDSDSDSDSDSDSDSDSDSDSDSESDSDSDSGSNNNVVPPNSPKNGTNASNKNEAKDSKEPLPDTGSEDEANTSLIWGLLASLGSLLLFRRKKENKDKK

SEQ ID NO: 35467 - protein, 434 aa, Staphylococcus aureus [sequence omitted]

SEQ ID NO: 35468 - protein, 230 aa, Staphylococcus aureus; identical to SEQ ID NO: 31333
  subsp. aureus 21340

SEQ ID NO: 35469 - protein, 351 aa, Staphylococcus aureus
  subsp. aureus 21340
MKNKKRVLIASSLSCAILLLSAATTQANSAHKDSQDQNKKEHVDKSQQKEKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 35470 - protein, 338 aa, Staphylococcus aureus; identical to SEQ ID NO: 34423
  subsp. aureus 21340

SEQ ID NO: 35471 - protein, 274 aa, Staphylococcus aureus; identical to SEQ ID NO: 30872
  subsp. aureus 21340

SEQ ID NO: 35472 - protein, 96 aa, Staphylococcus aureus; identical to SEQ ID NO: 30813
  subsp. aureus 21340

SEQ ID NO: 35473 - protein, 327 aa, Staphylococcus aureus; identical to SEQ ID NO: 34061
  subsp. aureus 21340

SEQ ID NO: 35474 - protein, 311 aa, Staphylococcus aureus; identical to SEQ ID NO: 34664
  subsp. aureus 21340

SEQ ID NO: 35475 - protein, 476 aa, Staphylococcus aureus
  subsp. aureus 21340
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNVFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNNKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35476 - protein, 241 aa, Staphylococcus aureus; identical to SEQ ID NO: 33853
  subsp. aureus 21340

SEQ ID NO: 35477 - protein, 231 aa, Staphylococcus aureus; identical to SEQ ID NO: 33623
  subsp. aureus 21340

SEQ ID NO: 35478 - protein, 2484 aa, Staphylococcus aureus
  subsp. aureus 21340
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVIDKINAIQTQAKVKPAADTEVENAYNTRKQEIQNSNASTTEEKQAAYTELDTKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPQAKQAIADKVQAQETAIDANNGSTTEEKTAAKQQAQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKENAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQTSVGPVANNKAKDMQTNDMKASLATVSNGSNSANQDMLNVTNTDDHQAKTKSAQQGKVNKPKQQAKTLPDTGMSHNDDLPYAELALGAGMAFLIRRSTKKDQQTEE

SEQ ID NO: 35479 - protein, 331 aa, Staphylococcus aureus; identical to SEQ ID NO: 34781
  subsp. aureus 21340

SEQ ID NO: 35480 - protein, 690 aa, Staphylococcus aureus
  subsp. aureus 21340
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 35481 - protein, 203 aa, Staphylococcus aureus; identical to SEQ ID NO: 31344
  subsp. aureus 21340

SEQ ID NO: 35482 - protein, 226 aa, Staphylococcus aureus; identical to SEQ ID NO: 31343
  subsp. aureus 21340

SEQ ID NO: 35483 - protein, 231 aa, Staphylococcus aureus; identical to SEQ ID NO: 31342
  subsp. aureus 21340

SEQ ID NO: 35484 - protein, 356 aa, Staphylococcus aureus; identical to SEQ ID NO: 31598
  subsp. aureus 21340

SEQ ID NO: 35485 - protein, 315 aa, Staphylococcus aureus
  subsp. aureus 21340
MKITTIAKTSLALGLLTTGVITTTTQAANATTPPSTKVETPQQVANATTPSSTKVEAPQQAANATTPSSTKVEAPQSKPNATTPSSTKVEAPQSKPNATTPPSSNVDTSPPQSPTTKQVPTEINPKFKDLRAYYTKPSLEFKSEIGIILKKWTTIRFMNVVPDYFIYKIALVGKDDNKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 35486 - protein, 234 aa, Staphylococcus aureus
  subsp. aureus 21340
MKMTAIAKASLALGILATGTITSLHQTVNASEHKAKYENVTKDIFDLRDYYSGASKELKNVTGYRYSKGGKHYLIFDKNRKFTRVQIFDKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 35487 - protein, 232 aa, Staphylococcus aureus; identical to SEQ ID NO: 31338
  subsp. aureus 21340

SEQ ID NO: 35488 - protein, 231 aa, Staphylococcus aureus
  subsp. aureus 21340
MKLKTLAKATLALGLLTTGVITSEGQAVQAKEKQERVQHLYDIKDLHRYYSSESFEFSNISGKVENYNGSNVVRFNQENQNHQLFLSGKDKDKYKEGLEGQNVFVVKELIDPNGRLSTVGGVTKKNNQSSETNTPLFIKKVYGGNLDASIESFLINKEEVSLKELDFKIRQHLVKNYGLYKGTTKYGKITFNLKDGEKQEIDLGDKLQFEHMGDVLNSKDIQSIAVTINQI

SEQ ID NO: 35489 - protein, 232 aa, Staphylococcus aureus; identical to SEQ ID NO: 31593
  subsp. aureus 21340

SEQ ID NO: 35490 - protein, 232 aa, Staphylococcus aureus
  subsp. aureus 21340
MKFTALAKATLALGILTTGVFTTESKAVHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVNNPSLQVKKIDPKHGFSINELFFIQKEEVSLKELDFKIRKMLVEKYRLYKGASDKGRIVINMKDEKKYVIDLSEKLSFDRMFDVMDSKQIKNIEVNLN

SEQ ID NO: 35491 - protein, 227 aa, Staphylococcus aureus; identical to SEQ ID NO: 31334
  subsp. aureus 21340

SEQ ID NO: 35492 - protein, 141 aa, Staphylococcus aureus; identical to SEQ ID NO: 30633
  subsp. aureus 21340

SEQ ID NO: 35493 - protein, 815 aa, Staphylococcus aureus
  subsp. aureus 21340
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINKTKVEVKAKGMFILKKKDDKTYECSFYNPESTNTASDIESKISMTGYSITNKNTSTSNESGVRFELQQTLNKDDN

SEQ ID NO: 35494 - protein, 46 aa, Staphylococcus aureus
  subsp. aureus 21340
YDDEQNIEYNFYNLNGEYGYEVLKMYADNKTINSDKLHLDIYLFKS

SEQ ID NO: 35495 - protein, 241 aa, Staphylococcus aureus
  subsp. aureus 21340
MKKNIMNKLVLSTALLLLGTTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPRNAEIEVILEKSN

SEQ ID NO: 35496 - protein, 241 aa, Staphylococcus aureus; identical to SEQ ID NO: 30739
  subsp. aureus 21340

SEQ ID NO: 35497 - protein, 238 aa, Staphylococcus aureus; identical to SEQ ID NO: 30740
  subsp. aureus 21340

SEQ ID NO: 35498 - protein, 319 aa, Staphylococcus aureus; identical to SEQ ID NO: 30741
  subsp. aureus 21340

SEQ ID NO: 35499 - protein, 165 aa, Staphylococcus aureus; identical to SEQ ID NO: 31315
  subsp. aureus 21340

SEQ ID NO: 35500 - protein, 109 aa, Staphylococcus aureus; identical to SEQ ID NO: 30603
  subsp. aureus 21340

SEQ ID NO: 35501 - protein, 350 aa, Staphylococcus aureus
  subsp. aureus 21340
MTKHYLNSKYQSEQRSSAIKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 35502 - protein, 644 aa, Staphylococcus aureus
  subsp. aureus 21340
MNKQQKEFKSFYSIRKSSLGVASVAISTLLLLMSNGEAQAAEETGGTNTEAQPKTEAVASPTTTSEKAPETKPVANAVSVSNKEVEAPTSETKEAKEVKEVKAPKETKEVKPAAKATNNTYPILNQELREAIKNPEIKDKDHSAPNSRPIDFEMKKKDGTQQFYHYASSVKPARVIFTDSKPEIELGLQSGQFWRKFEVYEGDKKLPIKLVSYDTVKDYAYIRFSISNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPAKGEVESSSTTPTKVVSTTQNVVKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 35503 - protein, 291 aa, Staphylococcus aureus; identical to SEQ ID NO: 30390
  subsp. aureus 21340

SEQ ID NO: 35504 - protein, 187 aa, Staphylococcus aureus
  subsp. aureus 21340
MLEEILTNSASAIEYSDLHHKSKFDSKRLSNAKMSFINPTQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQAEIELTAVKTKKKIVTIQELDVQLRNYLNEKYKLYEQGGDIVKGYVKY

SEQ ID NO: 35505 - protein, 2182 aa, Staphylococcus aureus
  subsp. aureus 21340
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESTNPYTIDIIMNKDALQAEVDRRIQQADYTFASLDIFNGLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVGTAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTDATTEEKQVALNQVDQELATAINNINQADTNAEVDQAQQLGTKAINAIQPNIVKKPAALAQINQHYNVKLAEINATPDATNDEKNAAINTLNQDRQQAIESIKQANTNAEVDQAATTAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAQINQDKEATAEERQAALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVESNGIATLKGVEPHIVVKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVISRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 35506 - protein, 896 aa, Staphylococcus aureus
  subsp. aureus 21340
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEDKVADTDVAENSSTATNPKDASDKADVIEPESDMVKDTDSSVDKDAHLNIDHSSTNMMNNTHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 35507 - protein, 325 aa, Staphylococcus aureus; identical to SEQ ID NO: 30407
  subsp. aureus 21340

SEQ ID NO: 35508 - protein, 315 aa, Staphylococcus aureus; identical to SEQ ID NO: 30440
  subsp. aureus 21340

SEQ ID NO: 35509 - protein, 321 aa, Staphylococcus aureus
  subsp. aureus 21340
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNIDATYAYVTRHRLAVDRKHDAFKNRNVTVKYEVNWKTHEVKIKSITPK

SEQ ID NO: 35510 - protein, 372 aa, Staphylococcus aureus
  subsp. aureus 21340
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNEPTKEIKIANLEAQNSNQKKTNKVTNNYFGYYSFREAPKTQIYTVKKGDTLSAIALKYKTTVSNIQNTNNIANPNLIFIGQKLKVPMTPLVEPKTKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 35511 - protein, 112 aa, Staphylococcus aureus; identical to SEQ ID NO: 34751
  subsp. aureus 21342

SEQ ID NO: 35512 - protein, 206 aa, Staphylococcus aureus; identical to SEQ ID NO: 34750
  subsp. aureus 21342

SEQ ID NO: 35513 - protein, 165 aa, Staphylococcus aureus; identical to SEQ ID NO: 31241
  subsp. aureus 21342

SEQ ID NO: 35514 - protein, 105 aa, Staphylococcus aureus; identical to SEQ ID NO: 31168
  subsp. aureus 21342

SEQ ID NO: 35515 - protein, 354 aa, Staphylococcus aureus; identical to SEQ ID NO: 30412
  subsp. aureus 21342

SEQ ID NO: 35516 - protein, 652 aa, Staphylococcus aureus; identical to SEQ ID NO: 34746
  subsp. aureus 21342

SEQ ID NO: 35517 - protein, 246 aa, Staphylococcus aureus
  subsp. aureus 21342
MINKIKILFSFLALLLSFTSYAKAEDLHDKSELTDLALANAYGQYNHPFIKENIKSDEISGEKDLIFRNQGDSGNDLRVKFATADLAQKFKNKSVDIYGASFYYKCEKISENISECLYGGTTLNSEKLAQERVIGANVWVDGIQKETELIRTNKKNVTLQELDIKIRKILSDKYKIYYKDSEISKGLIEFDMKTPRDYSFDIYDLKGENDYEIDKIYEDNKTLKSDDISHIDVNLYTKKSIINENF

SEQ ID NO: 35518 - protein, 278 aa, Staphylococcus aureus; identical to SEQ ID NO: 34714
  subsp. aureus 21342

SEQ ID NO: 35519 - protein, 2188 aa, Staphylococcus aureus
  subsp. aureus 21342
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVTLGDIEAVITEKENSLLRIDNIAQQTYAKFKAIATPEQLAKVKALIDQYVADGNRMVDEDATLNDIKKDTQLIIDEILAIKLPAEVIKASPKVGQPAPKVCTPIKKEDKQEVRKVVKELPNTGSEEMDLPLKELALITGAALLARRRSKKEKES

SEQ ID NO: 35520 - protein, 331 aa, Staphylococcus aureus; identical to SEQ ID NO: 31235
  subsp. aureus 21342

SEQ ID NO: 35521 - protein, 142 aa, Staphylococcus aureus
  subsp. aureus 21342
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQA

SEQ ID NO: 35522 - protein, 141 aa, Staphylococcus aureus; identical to SEQ ID NO: 31214
  subsp. aureus 21342

SEQ ID NO: 35523 - protein, 808 aa, Staphylococcus aureus; identical to SEQ ID NO: 31215
  subsp. aureus 21342

SEQ ID NO: 35524 - protein, 238 aa, Staphylococcus aureus; identical to SEQ ID NO: 31240
  subsp. aureus 21342

SEQ ID NO: 35525 - protein, 241 aa, Staphylococcus aureus; identical to SEQ ID NO: 31239
  subsp. aureus 21342

SEQ ID NO: 35526 - protein, 241 aa, Staphylococcus aureus; identical to SEQ ID NO: 31173
  subsp. aureus 21342

SEQ ID NO: 35527 - protein, 833 aa, Staphylococcus aureus
  subsp. aureus 21342
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSESDSDSDSDSDSDSDSDSDSDSDSDSDSDSDSDSDSDSDSESDSDSDSDSDSDSDSDS

SEQ ID NO: 35528 - protein, 434 aa, Staphylococcus aureus [sequence omitted]

SEQ ID NO: 35529 - protein, 364 aa, Staphylococcus aureus
  subsp. aureus 21342
MKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNKPGKEDGNKPGKEDNKKPGKEDGNK

SEQ ID NO: 35530 - protein, 221 aa, Staphylococcus aureus; identical to SEQ ID NO: 31036
  subsp. aureus 21342

SEQ ID NO: 35531 - protein, 139 aa, Staphylococcus aureus
  subsp. aureus 21342
SASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 35532 - protein, 234 aa, Staphylococcus aureus; identical to SEQ ID NO: 30530
  subsp. aureus 21342

SEQ ID NO: 35533 - protein, 232 aa, Staphylococcus aureus
  subsp. aureus 21342
MKMTQIAKTSLALSLLTTGASIVTTQSANAEVASALKTEQAIKSKIQKVTTSPSTKVKATQPTPSVTTTTPPSPNVQPQSPQPTPSVTTPPSPNVQPQSPQPTPNPTTPHSSNVETKQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSI

SEQ ID NO: 35534 - protein, 343 aa, Staphylococcus aureus; identical to SEQ ID NO: 31263
  subsp. aureus 21342

SEQ ID NO: 35535 - protein, 233 aa, Staphylococcus aureus; identical to SEQ ID NO: 31264
  subsp. aureus 21342

SEQ ID NO: 35536 - protein, 226 aa, Staphylococcus aureus; identical to SEQ ID NO: 31265
  subsp. aureus 21342

SEQ ID NO: 35537 - protein, 143 aa, Staphylococcus aureus
  subsp. aureus 21342
PGKEDNNKPGKEDGNKPGKEDGNKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35538 - protein, 232 aa, Staphylococcus aureus; identical to SEQ ID NO: 31257
  subsp. aureus 21342

SEQ ID NO: 35539 - protein, 122 aa, Staphylococcus aureus
  subsp. aureus 21342
NKYQLKKYSVGGITKTNSKKVDHKAELSITKKDEKGKISHDDSEYKITKEEISLKELDFKLRKQLIEQHNLYGNIGSGTIVIKTKNGGKYTFELHKKLQEHRMADVIDGTSIERIEVNLKSS

SEQ ID NO: 35540 - protein, 234 aa, Staphylococcus aureus; identical to SEQ ID NO: 30567
  subsp. aureus 21342

SEQ ID NO: 35541 - protein, 231 aa, Staphylococcus aureus; identical to SEQ ID NO: 30566
  subsp. aureus 21342

SEQ ID NO: 35542 - protein, 232 aa, Staphylococcus aureus; identical to SEQ ID NO: 30565
  subsp. aureus 21342

SEQ ID NO: 35543 - protein, 227 aa, Staphylococcus aureus; identical to SEQ ID NO: 30564
  subsp. aureus 21342

SEQ ID NO: 35544 - protein, 1024 aa, Staphylococcus aureus
  subsp. aureus 21342
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDST

SEQ ID NO: 35545 - protein, 349 aa, Staphylococcus aureus
  subsp. aureus 21342
KGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 35546 - protein, 1098 aa, Staphylococcus aureus
  subsp. aureus 21342
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAK

SEQ ID NO: 35547 - protein, 309 aa, Staphylococcus aureus; identical to SEQ ID NO: 33946
  subsp. aureus 21342

SEQ ID NO: 35548 - protein, 315 aa, Staphylococcus aureus; identical to SEQ ID NO: 31191
  subsp. aureus 21342

SEQ ID NO: 35549 - protein, 325 aa, Staphylococcus aureus; identical to SEQ ID NO: 30479
  subsp. aureus 21342

SEQ ID NO: 35550 - protein, 942 aa, Staphylococcus aureus
  subsp. aureus 21342
MIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQAKKSELPETGGEESTNKGMLFGGLFSILGLALLRRNKKNHKA

SEQ ID NO: 35551 - protein, 258 aa, Staphylococcus aureus; identical to SEQ ID NO: 30518
  subsp. aureus 21342

SEQ ID NO: 35552 - protein, 251 aa, Staphylococcus aureus; identical to SEQ ID NO: 30505
  subsp. aureus 21342

SEQ ID NO: 35553 - protein, 243 aa, Staphylococcus aureus; identical to SEQ ID NO: 33974
  subsp. aureus 21342

SEQ ID NO: 35554 - protein, 242 aa, Staphylococcus aureus; identical to SEQ ID NO: 30522
  subsp. aureus 21342

SEQ ID NO: 35555 - protein, 239 aa, Staphylococcus aureus; identical to SEQ ID NO: 30171
  subsp. aureus 21342

SEQ ID NO: 35556 - protein, 254 aa, Staphylococcus aureus; identical to SEQ ID NO: 31226
  subsp. aureus 21342

SEQ ID NO: 35557 - protein, 233 aa, Staphylococcus aureus; identical to SEQ ID NO: 31039
  subsp. aureus 21342

SEQ ID NO: 35558 - protein, 918 aa, Staphylococcus aureus
  subsp. aureus 21342
MSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSEPSVRTRAVRSLAVAEPVVNAADAKGTNVNDKVTASDFKLEKTTFDPNQSGNTFMAANFKVAGKVKSGDYFTAKLPDSVTGNGDVDYSNSNNTMPIADIVNDKKEVVAKATYDILTKTYTFVFTDYVNDKENINGQFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPEPTPDPEPSPDPDPEPTPDPEPSPEPDPDSDSDSDSGSDSDSGSDSDSDSDSDSDSDSDSESDSDSDSDSDSDSDSDSDSDSDSESDSESDSDSDSDSDSDSDSDSDSDSDSDSESDSDSDSDSDSDSDSDSDSDSDSESDSDSDSDSDSDSDSDSDSDSDSNSDSESDSDSDSDSDSDSESDSESDSDSDSESDSDSDSDSESDSDSDSDSDSDSDSDSESDSDSDSDSDSDSDSDSDSDSDSESDSDSDSDSDSDSDSDSDSDSDSESDSDSDSDSRVTPPNNEQKAPSNPKGEVNHSNKASKQHQTDALPETGDKSENTNATLFGAMMALLGSLLLFRKRKQDHKEKA

SEQ ID NO: 35559 - protein, 2275 aa, Staphylococcus aureus
  subsp. aureus 21342
MTGYGLKTTAVIGGAFTINMLHDQQAFAASDAPLTSELNTQSETVGNQNSTTIEASTSTADSTSVTKNSSSEQTSNSDTVSSEKSENVTSTTNSTSNQQEKLTSTSESTSSKNTTSSSDTKSVASTSSTEQQTNISTNQSTASNTTSQSTAPASTHLKQTSTTSTSTAPVKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSSVAGGGAFGAFVTTDSTGVATTYTSSSTADNAAKLKVQPTNNTFQNFDITYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIMTSTSVSTSKSTSTSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSNSTSNSISTSESLSESVSTSESISISNSISNSVSASTSKSDSQSTSISLSTSDSKSMSTSESLSDSMSTSDSVSGSLSVAGSQSVSTSTSDSMSTSEMISDSMSTSGSLAASDSKSMSVSSSMSTSQSGSTSESLSDSQSTSDSDSKSLSLSTSQSGSTSTSTSTSSSVRMSESQSTSGSMSTSQSDSTSISTSFSDSTSDSKSASTASSESISQSVSTSTSDSMSTSTSLSTSNSERTSTSLSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSESKSDSTSMSLSMSQSTSGSTSVSTSESLSDSTSTSLSLSASMNQSGVDSNSASQSASTSTSTSTSESDSQSTSSYTSQSTSQSESTSTSTSLSDSTSMSRSTSQSGSTSTSASLSGSESESDSQSISTSTSESKSESTSTSLSDSTSISNSGSASTSTSLSNSASASESDSSSTSLSDSTSASMQSSESDSQSTSRSTSASGSASTSTSTSDSRSTSASTSTSMRTSTSDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSTSLSGSESVSESSSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSISVSDSSSTSTSESLSDSMAQSQSTSTSASGSLSTSISSSMSASASTSTSQSTSVSTSLSTSDSISDSTSISISGSQSAVESESTSDSTSISDSESLSTSGSDSTSTSTSDSTSTSLSLSTSGSISGSTSTSASGSLSMSNSGSTSVSDSLSTSGSLSTSGSTSVSDSTSMSESNSASISMSQSISGSTSGSTSISTSESLSMSGSTHNSTSVSDSDSVSMSNSTSTSMSDSTSVSDSESVSTSASTSLSTSDSTSTSESLSASMSGSQSISDSTSTSMSDSTSMSDSESVSMSNSMSLSTSESLSASMSGSQSISDSTSTSMSNSMSMSTSESNSMHPSDSMSMHHTHSTSTSISTSEATTSTSESQSTLSATSEATKHNGTRAQSEERLPDTGDSIKQNGLLGGVMTLLVGLGLMKRKKKKDENEQDDSQA

SEQ ID NO: 35560 - protein, 681 aa, Staphylococcus aureus
  subsp. aureus 21342
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDGKKSSLNNKNIQRDTTKNNNANPSDVNQGLEQAINDGKQSKVASQQQSKEADNSQDSNANNNLPSQSRTKEAPPLNKSDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELMRNGSREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 35561 - protein, 689 aa, Staphylococcus aureus; identical to SEQ ID NO: 31861
  subsp. aureus 21342

SEQ ID NO: 35562 - protein, 54 aa, Staphylococcus aureus
  subsp. aureus 21342
MKVINTYSIRKCNIGVASFIIGSFLFLGVNGNIAEANDERQEVDNGQQQKLNEA

SEQ ID NO: 35563 - protein, 344 aa, Staphylococcus aureus
  subsp. aureus 21342
KADNDRQEVDNSQQELLKKINESTNRESTVKRLLEDVYSKENARGILNKIKPEDYNLSSKELINKIIKAGIDYSEENNSKYKVFASVPQASITLKSEYNIGNSLVVRSDKVIKPEDYVNYPEGYHVQSYVSKGKEYPSLDDIVKKRVTGSYKITYRLLDSNDEPVHGEDGQAIVRSLNIYFYNPEPALDIIKEIEEDIDENNYQNGEEIKEDLEKIKNELEKPTKIPDVPALIDEINNKKNQLENLDTTAPDAPKVKDTESGSKKITGEGSEPGNDITVTFPSGKTSQGKVGQDDSDSDSGKEVLPETGEQSNSNNATLFGSLFAGLGSLFLFGRRRKKDADNK

SEQ ID NO: 35564 - protein, 231 aa, Staphylococcus aureus; identical to SEQ ID NO: 31216
  subsp. aureus 21342

SEQ ID NO: 35565 - protein, 62 aa, Staphylococcus aureus; identical to SEQ ID NO: 31886
  subsp. aureus 21342

SEQ ID NO: 35566 - protein, 167 aa, Staphylococcus aureus; identical to SEQ ID NO: 31885
  subsp. aureus 21342

SEQ ID NO: 35567 - protein, 291 aa, Staphylococcus aureus; identical to SEQ ID NO: 30390
  subsp. aureus 21342

SEQ ID NO: 35568 - protein, 274 aa, Staphylococcus aureus
  subsp. aureus 21342
MYPNWGQYKRAYLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTEEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 35569 - protein, 339 aa, Staphylococcus aureus; identical to SEQ ID NO: 31219
  subsp. aureus 21342

SEQ ID NO: 35570 - protein, 351 aa, Staphylococcus aureus; identical to SEQ ID NO: 31218
  subsp. aureus 21342

SEQ ID NO: 35571 - protein, 372 aa, Staphylococcus aureus; identical to SEQ ID NO: 33950
  subsp. aureus 21342

SEQ ID NO: 35572 - protein, 691 aa, Staphylococcus aureus; identical to SEQ ID NO: 31040
  subsp. aureus 21342

SEQ ID NO: 35573 - protein, 291 aa, Staphylococcus aureus; identical to SEQ ID NO: 30390
  subsp. aureus 21343

SEQ ID NO: 35574 - protein, 230 aa, Staphylococcus aureus; identical to SEQ ID NO: 30380
  subsp. aureus 21343

SEQ ID NO: 35575 - protein, 227 aa, Staphylococcus aureus
  subsp. aureus 21343
MKFTALAKATLALGILTTGTLTTEAHSSHAKQNQESVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNVTKEKGEDAFVKGYPYYIKKEKITLKELDFKLRKHLIEKYGLYKTISKDGRVKISLKDGSFYNLDLRSKLKFKYMGEVIESKQIKDIEVNLK

SEQ ID NO: 35576 - protein, 232 aa, Staphylococcus aureus
  subsp. aureus 21343
MKLTTIAKATLALGILTTGVFTAESQTGHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKIDPKHGFSINELFFIQKEEVSLKELDFKIRKLLIEKYRLYKGTSDKGRIIINMKDEKKHEIDLSEKLSFERMFDVMDSKKIKNIEVNLN

SEQ ID NO: 35577 - protein, 232 aa, Staphylococcus aureus
  subsp. aureus 21343
MKFTAIAKAIFVLGILTTSVMITENQSVNAKGKYEKMNHLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKEIDFKIRKLLIKKYKLYEGSADKGRIVINMKDENKYEIDLSDKLDFERMADVISSEQIKNIEVNLK

SEQ ID NO: 35578 - protein, 231 aa, Staphylococcus aureus
  subsp. aureus 21343
MKLKTLAKATLALGLLTTGVITSEGQAVQAKEKQERVQHLYDIKDLHRYYSSESFEFSNISGKVENYNGSNVVRFNQDGQNHQLFLLGEDKDKYKKGLEGQNVFVVKELIDPNGRLSTVGGVTKKNNQSSETNTPLVVNKVYGGDLHASIDSFSINKEEVSLKELDFKIRKQLVEKYGLYQGTSKYGKITIILNGGKKEVIDLGDKLQFERMGDVLNSKDINKIEVTLKQI

SEQ ID NO: 35579 - protein, 232 aa, Staphylococcus aureus
  subsp. aureus 21343
MKLKTIAKATLALGLLATGVITTESQTVKAAESTQGQHNYKSLKYYYSKPSIELKNLDGLYRQHLTDKGAYVWKNLKDYYIGLLGEDSKKFKTDVYGDLDAFLVIEEEPVKGRQYSIGGISKTNSKEFKEREVDVKVTRKADKDTTSTKNSKFKITKEEISLKELDFKLRQKLMKEENLYDAINHRIGKIVIKMADDKFYTFELTKKLQPHRMGDTIDGTKIKEISVELEYK

SEQ ID NO: 35580 - protein, 234 aa, Staphylococcus aureus
  subsp. aureus 21343
MKMAAIAKASLALGILATGTITSLHQTVNASEHEAKYENVTKDIFDLRDYYSGASKELKNVTGYRYSKGGKHYLIFDKHQKFTRIQIFGKDIERLKTRKNPGLDIFVVKEAENRNGTVFSYGGVTKKNQGAYYDYLNAPRFVIKKEVDVGVYTHVKRHYIYKEEISLKELDFKLRQYLIQNFDLYKKFPKDSKIKVIMKDGGYYTFELNKKLQTNRMSDVIDGRNIEKIEANIR

SEQ ID NO: 35581 - protein, 330 aa, Staphylococcus aureus
  subsp. aureus 21343
MKITTIAKTSLALGLLTTGVITTTTQAANATTPSSTKIEAPQQVANATTPSSTKVEAPQQAANATTPSSTKVETPQQTPNATTPPSTKVEAPKQTPNAPTPPSTKVEAPKQTPNAPTPPSTKVETPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIENHNLYGNVGSGKIVIKMKNGGKYTFELHKKLQENRMADVIDGTNIDNIEVNIK

SEQ ID NO: 35582 - protein, 356 aa, Staphylococcus aureus; identical to SEQ ID NO: 33847
  subsp. aureus 21343

SEQ ID NO: 35583 - protein, 231 aa, Staphylococcus aureus; identical to SEQ ID NO: 30768
  subsp. aureus 21343

SEQ ID NO: 35584 - protein, 226 aa, Staphylococcus aureus
  subsp. aureus 21343
MKFKAIAKASLALGMLATGVITSNVQSVQAKTEVKQQSEADLKLYYSGPSFEHKKVTGFKYTDEKGSFFEFIDRGQFNKVSLVGPDKDKLNDGDNSGLDVFVVREGYGRQADNHSIGGVTKTNRQSYFDQINTPILEIKNDSEDLYKGYHLIFKEDISLKELDYRLRERAIKQHGLYSNGLKQGQITITMNDGTTHTIDLSQKLEKERMGESIDGRQIQKILVEMK

SEQ ID NO: 35585 - protein, 203 aa, Staphylococcus aureus; identical to SEQ ID NO: 30345
  subsp. aureus 21343

SEQ ID NO: 35586 - protein, 691 aa, Staphylococcus aureus
  subsp. aureus 21343
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKQQSTQNSKTIRTQNDNQVKQDSERQGSKQSNQNNATNNTERQNDQVQNTHHAERNRSQSTTSQSNDVDKSQPSIPAQKVLPNHDKAATTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 35587 - protein, 241 aa, Staphylococcus aureus; identical to SEQ ID NO: 31311
  subsp. aureus 21343

SEQ ID NO: 35588 - protein, 241 aa, Staphylococcus aureus; identical to SEQ ID NO: 30739
  subsp. aureus 21343

SEQ ID NO: 35589 - protein, 238 aa, Staphylococcus aureus; identical to SEQ ID NO: 30740
  subsp. aureus 21343

SEQ ID NO: 35590 - protein, 319 aa, Staphylococcus aureus; identical to SEQ ID NO: 30605
  subsp. aureus 21343

SEQ ID NO: 35591 - protein, 165 aa, Staphylococcus aureus; identical to SEQ ID NO: 30418
  subsp. aureus 21343

SEQ ID NO: 35592 - protein, 109 aa, Staphylococcus aureus; identical to SEQ ID NO: 33345
  subsp. aureus 21343

SEQ ID NO: 35593 - protein, 350 aa, Staphylococcus aureus
  subsp. aureus 21343
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKYESNNQAVSDNKSQQTNKVTKQNETPKQASKAKELPKTGLTSVDNFISTVAFATLALLGSLSLLLFKRKESK

SEQ ID NO: 35594 - protein, 643 aa, Staphylococcus aureus
  subsp. aureus 21343
MNKQQKEFKSFYSIRKSSLGVASVAISTLLLLMSNGEAQAAEETGGTNTEAQPKTEAVASPTTTEKAPEAKPVANAVSVSNKEVEAPTSETKEAKEVKEVKAPKETKAVKPAAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKNLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 35595 - protein, 233 aa, Staphylococcus aureus; identical to SEQ ID NO: 30428
  subsp. aureus 21343

SEQ ID NO: 35596 - protein, 879 aa, Staphylococcus aureus
  subsp. aureus 21343
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQRTSKPSVRTRAVRSLAVAEPVVNAADAKGTNVNGQVTASDFKLEKTTFDPNQSGNTFMAVNFKVAGKVKSGDYYTAKLPDSLTGNGDVDYSNSNNTMPIADIKSTNGDVVAKATYDILTKTYTFVFTDYVNDKENINGQFSLPLFTDRTKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTTEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPEPTPDPEPSPDPDPDSDSDSDSGSDSDSGSDSDSDSDSDSESDSDSDSDSDSDSDSDSDSDSDSDSDSNSDSDSDSESDSDSESDSDSESDSDSDSDSDSESDSDSDSDSESDSDSDSDSDSDSESDSDSESDSDSESDSESDSDSDSDSDSDSESDSDSESDSDSESDSDSDSDSDSDSDSDSDSDSDSDSDSESDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLLRKRKQDHKEKA

SEQ ID NO: 35597 - protein, 2261 aa, Staphylococcus aureus
  subsp. aureus 21343
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLGDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLIKRKKKKDENDQDDSQA

SEQ ID NO: 35598 - protein, 681 aa, Staphylococcus aureus
  subsp. aureus 21343
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSLTKEAPSLNKSDQTSQREIVNETEIEKVQPQQNNQANDKITNHNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 35599 - protein, 434 aa, Staphylococcus aureus [sequence omitted]

SEQ ID NO: 35600 - protein, 953 aa, Staphylococcus aureus
  subsp. aureus 21343
MNMKKKEKYAIRKKSIGVASVLVGTLIGFGLLSSKEADASENSVTQSDSASNESKSNDSSSINAAPKTDNTNVSDTKTTSNTNNGETSVAQNPAQQETTQSASTNATTEETPVTGETTTTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 35601 - protein, 327 aa, Staphylococcus aureus; identical to SEQ ID NO: 34061
  subsp. aureus 21343

SEQ ID NO: 35602 - protein, 311 aa, Staphylococcus aureus
  subsp. aureus 21343
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKSNEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 35603 - protein, 231 aa, Staphylococcus aureus
  subsp. aureus 21343
MKKTLLASSLAVGLGIVAGNAGHEAHASEADLNKASLAQMAQSNDQTLNQKPIEAGAYNYTFDYEGFTYHFESDGTHFAWNYHATGANGANMSAQAPATNNVEPSAVQANQVQSQEVEAPQNAQTQQPQALTSNNSQVTATPTESKASEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 35604 - protein, 2494 aa, Staphylococcus aureus
  subsp. aureus 21343
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPVNAPAAAQPAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKSDQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQTDIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAVTARKAQNATVSNATNEEVAEADAAVDAAQKQGLHDIQVVKSKQEVADTKSKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNAAANADVDNAKTTNEATIAAITPDSNVKPAAKQAIADKVQAQETAIDANNGSTTEEKEAAKQQVQTEKTAADAAIDAAHSNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQAAQTAVINNDQNATNEEKEAAIQQLATAVTDAKNNITAAADNNGVDTAKDAGKNSIQSTQPATAVKSNAKNDVDQAVTTQNQAIDNTTGATTEEKNAAKDLVSKAKEKAYQDILNAQTTNDVTQIKDQAVADIQGITADTTIKDVAKGELAAKANEQKALIAQTVDATTEEKDQANQQVDAQLTQGNQNIENAQSIDDVNTAKDNAIQAIDPIQASTDVKTNARAELLNEMQNKITEILNDNTTTNEEKGKDIGPVRAAYEEGLNNINAATTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADTYNAKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEPASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQTSVGPVANNKAKDMQTNDTQKSVGSVANNKATQNDGANASPATVSNGSNSANQDMLNVTKPEENKANAKSDQQGKVNKPKQQAKTLPDTGMSHNDDLPYAELALGAGMAFLIRRFTKKDQQTEE

SEQ ID NO: 35605 - protein, 102 aa, Staphylococcus aureus; identical to SEQ ID NO: 35189
  subsp. aureus 21343

SEQ ID NO: 35606 - protein, 437 aa, Staphylococcus aureus
  subsp. aureus 21343
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFET

SEQ ID NO: 35607 - protein, 903 aa, Staphylococcus aureus
  subsp. aureus 21343
MGAVSVFLGTIIVVGMGQEKEAAASEQNNTTVEESGSSATESKASETQTTTNNVNTIDETQSYSVTSTEQPSQSTQVTTEEAPTTVQAPKVETSRVDLPSEKVADKETTGTQVDTAQPSNFSEIKPRVKRSADVAVVAGEAKATGTDVTNKVTVENGSEIVGHKQDTNVVNPHNAERVTLKYKWKFGEGIKEGDYFDFTLSDNVETHGISTLRKVPEIKSTDGQVMAIGEVVEERKIRYTFKEYVKDKKDLTAELSLNLFIDPTTVTKQGKQKVEVTLGDKTIEKEFDIKYLDGVKDRMGVTVNGRIDTLNKEDGKFSHFAYIKPNNRSLSSVTVTGQVTSGHKQNANNPTVKVYKRIGSDELAESVYAKLDDASKFEDVTEKVNLSYTGEGGYSFTFDSLEDNNNYVVKYEGEYNTKAKDLNFQTRLTGYHNYYPYYPYYPVQLTWNNGVAFYSNNAQGDGKDKPKEPIIEHSTPIELEFKSEQPVKKHELTGTIEESNDSKPIDFEYHTAVEGVEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHYISHSGLGTENGHGNYGVIEEIEENSHVDIKSELGYEGGQNSGDQSFEEDTEKDKPKYEQGGNIIDIDFDSVPHIHGFNKHTEIIEEDTNKDKPNYQFGGHSSVDFEEDTLPQVSGHNEGQQTIEEDTIPPIVPPTPPTPEVPSEPETPTPPTPEVPSEPGEPTPPTPEVPSEPETPVPPTPEVPSEPGKPVPPAKEEPKKPSKPVEQGKVVTPVIEINEKVKAVAPTKQKQSKKSELPETGGEESTNKGMLFGGVFSILGLALLRRNKKNHKA

SEQ ID NO: 35608 - protein, 1006 aa, Staphylococcus aureus; identical to SEQ ID NO: 34045
  subsp. aureus 21343

SEQ ID NO: 35609 - protein, 965 aa, Staphylococcus aureus
  subsp. aureus 21343
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDRDSDSDSDSDSDSDSDSDSDSDSDSDSDSDSDSDSDSDSDSDNDSDSDRDSDSDAGKHTPAKPMSTVKDQHKTAKALPETGSENNNSNNGTLFGGLFAALGSLLLFGRRKKQNK

SEQ ID NO: 35610 - protein, 1405 aa, Staphylococcus aureus
  subsp. aureus 21343
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNAETLVDNNSNSNNENNADIILPKSTAPKRLNTRMRMAAIQPNSTDSKNVNNLITSTTTLTVVDADKNNKIVPAQDYLTLKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVSRDNNSIGSAFTETVSHAGNAEDPGYYIQTVYVNPSEKTLTNAKLKVEAYHKDYPDNVGQINKNVTKIKIYQAPKDYVLNKGYDVNTNQLIDVTEQFKDKITYGTNDSVNVDFGSINNSYVVMVDTKFEFTTSESPTLVQMATLTSDGNRSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDTDSDSDSDSDSDSDSDSDSDSDSDTDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 35611 - protein, 1105 aa, Staphylococcus aureus
  subsp. aureus 21343
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTNHSTKPVATAPTSVAPKRLNAKMRFAVAQPATVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 35612 - protein, 809 aa, Staphylococcus aureus
  subsp. aureus 21343
MTYRMKKWQKLSTITLLMAGVITLNGGEFRSIDKHQIAVADTNVQTPDYEKLRNTWLDVNYGYDKYDEKNDAMKKKFDATEKEAEKLLSSMKTESGRTYLWDSAKDLDNKSADMTRTYRNIEKIAEAMRHPKTTLNTDENKKKVKDALEWLHKNAYGKEPDNKVKELTENFKITDSSKKKALNWWDYEIGTPRSLTNTLILLNDQFSNEEKKKFTAPIKTFAPKSDEILSSVGKAEPAKGGNLVDIAKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDDSTKAKYKKIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSNSTQTFDINNTKVEVKAKGMFILKNKDDNTYECSFYNPESTNTASDIESKISMTGYSITNKNTSTSNESGVHFELTK

SEQ ID NO: 35613 - protein, 141 aa, Staphylococcus aureus; identical to SEQ ID NO: 30633
  subsp. aureus 21343

SEQ ID NO: 35614 - protein, 241 aa, Staphylococcus aureus; identical to SEQ ID NO: 33853
  subsp. aureus 21343

SEQ ID NO: 35615 - protein, 500 aa, Staphylococcus aureus
  subsp. aureus 21343
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNKFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDGNKPGKEDNNKPGKEDNKKPGKEDNKKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35616 - protein, 331 aa, Staphylococcus aureus
  subsp. aureus 21343
MSNQFKSEEERRQWEQFQAFQNQQNQQHQQYGQKKSKKGWFWGCGGCLLLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSEAKKTSKAKKDKQDTEVAVARSNSDNISYEASATTPATTSSADTDSEDSEKSSKDEDKQNASKSDKSSVEKSESNEETAPVEPMRQSKPTTSEAPPSQNIHNEDSMYDASTE

SEQ ID NO: 35617 - protein, 372 aa, Staphylococcus aureus; identical to SEQ ID NO: 30609
  subsp. aureus 21343

SEQ ID NO: 35618 - protein, 250 aa, Staphylococcus aureus
  subsp. aureus 21343
MGEFEVKYLTGFILILLLEGIFTNSASAIEYSDLHHKSKFDSKRLSNAKMSFINPTQLENKNTKDRLLKHDLLFHDMFVNDDWKKDFKVEFENEALSKKFINKDIDIFAGNYGYGCHGGATNKTQCSYGGVTLSDNNKYDDYKNIPCNLWIDGHQAEIELTAVKTKKKIVTIQELDVQLRNYLNEKYKLYEQGGDIVKGYVKYYNDDEQNVEYDFYNLNGEYGREVLKMYADNKTINSDKLHLDIYLFKS

SEQ ID NO: 35619 - protein, 895 aa, Staphylococcus aureus
  subsp. aureus 21343
MNNHHPKLRSFYSIRKSTLGVASVIVSTLFLITSQHQAQAAENTNTSDKISENQNNNATTTQQPKDTNQTQPATQPVNTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 35620 - protein, 2109 aa, Staphylococcus aureus
  subsp. aureus 21343
MNLLKKNKYSIRKYKVGIFSTLIGTVLLLSNPNGAQALTTDNNVQSDTNQATPVNSQDKDVANNRGLANSAQNTPNQSATTNQSTNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSRRAAPADPNATPADPGAAAAGNGGAPVAITAPYTPTTDPNANNAGQNAPNEVLSFDDNSIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVYVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRRVTFNETLTYKTYTQDFINSPAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNAEVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKYRALTDIGVTSTTAMVNSIRDDAVNQIGAVQPHVTKKQTATGVLNDLATAKKQEINQNTNATTEEKQVALNQVDQELATAINNINQANTNAEVDQAATVAENNIDAVQVDVVKKQAARDKITAEVAKRIEAVKQTPNATDEEKQAAVNQINQLKDQAFNQINQNQTNDQVDATTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVISRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEAMKVSPKVIQPAPKVCTPIKKEETHESRKVEKELPNTGSEGMDLPLKEFALITGAALLARRRTKNEKES

SEQ ID NO: 35621 - protein, 321 aa, Staphylococcus aureus; identical to SEQ ID NO: 30959
  subsp. aureus 21343

SEQ ID NO: 35622 - protein, 315 aa, Staphylococcus aureus; identical to SEQ ID NO: 30573
  subsp. aureus 21343

SEQ ID NO: 35623 - protein, 325 aa, Staphylococcus aureus
  subsp. aureus 21343
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISITNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 35624 - protein, 274 aa, Staphylococcus aureus; identical to SEQ ID NO: 30872
  subsp. aureus 21343

SEQ ID NO: 35625 - protein, 338 aa, Staphylococcus aureus; identical to SEQ ID NO: 31292
  subsp. aureus 21343

SEQ ID NO: 35626 - protein, 350 aa, Staphylococcus aureus
  subsp. aureus 21343
MKNKKRVLIASSLSCAILLLSAATTQANSAHKDSQDQNKKEHVDKSQQKEKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDNTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKEGQRLIVTYEVDWKNKTVKVVDKYSDNKSFREG

SEQ ID NO: 35627 - protein, 233 aa, Staphylococcus aureus; identical to SEQ ID NO: 31039
  subsp. aureus 21345

SEQ ID NO: 35628 - protein, 873 aa, Staphylococcus aureus
  subsp. aureus 21345
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSDSDSDSDSDSDSDSESDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 35629 - protein, 231 aa, Staphylococcus aureus; identical to SEQ ID NO: 31216
  subsp. aureus 21345

SEQ ID NO: 35630 - protein, 62 aa, Staphylococcus aureus; identical to SEQ ID NO: 31886
  subsp. aureus 21345

SEQ ID NO: 35631 - protein, 167 aa, Staphylococcus aureus; identical to SEQ ID NO: 31885
  subsp. aureus 21345

SEQ ID NO: 35632 - protein, 257 aa, Staphylococcus aureus; identical to SEQ ID NO: 31220
  subsp. aureus 21345

SEQ ID NO: 35633 - protein, 645 aa, Staphylococcus aureus
  subsp. aureus 21345
MLRGQEERKYSIRKYSIGVVSVLAATMFVVTSHEAQASEKIPTTNAAAQKETLNQPGEQGNAITSHQMQSGKQLDDMHKENGKSGTVTEGKDMLQSSKHQSTQNSKIIRTQNDNQVKQDSERQGSKQSHQNNATNKTERQNDQIQNTHHAERNGSQSTTSQSNDVDKSQPSIPAQKVIPNHDKAAPTSTTPPSNDKTAPKSTKEQDATTDKHPNQQDTHQPAHQIIDAKQDDNVHQSNQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKYKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLNGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWD

SEQ ID NO: 35634 - protein, 232 aa, Staphylococcus aureus; identical to SEQ ID NO: 31257
  subsp. aureus 21345

SEQ ID NO: 35635 - protein, 227 aa, Staphylococcus aureus; identical to SEQ ID NO: 30564
  subsp. aureus 21345

SEQ ID NO: 35636 - protein, 232 aa, Staphylococcus aureus; identical to SEQ ID NO: 30565
  subsp. aureus 21345

SEQ ID NO: 35637 - protein, 231 aa, Staphylococcus aureus; identical to SEQ ID NO: 30566
  subsp. aureus 21345

SEQ ID NO: 35638 - protein, 234 aa, Staphylococcus aureus; identical to SEQ ID NO: 30567
  subsp. aureus 21345

SEQ ID NO: 35639 - protein, 325 aa, Staphylococcus aureus; identical to SEQ ID NO: 33964
  subsp. aureus 21345

SEQ ID NO: 35640 - protein, 343 aa, Staphylococcus aureus; identical to SEQ ID NO: 31263
  subsp. aureus 21345

SEQ ID NO: 35641 - protein, 233 aa, Staphylococcus aureus; identical to SEQ ID NO: 31264
  subsp. aureus 21345

SEQ ID NO: 35642 - protein, 226 aa, Staphylococcus aureus; identical to SEQ ID NO: 31265
  subsp. aureus 21345

SEQ ID NO: 35643 - protein, 241 aa, Staphylococcus aureus
  subsp. aureus 21345
MKKNITNKIVLSTALLLLGTTSTQPPKAPISFSSEAKAYNISENETNINELIKYYTQPHLSFSGKWLWQKDNGTIHATLLQLSWFSHIQVFGPESWGNINQLRNKYVDIFALKDYETWRTYMLAQETFTGGVTPVAKPSDKHYKLNVTYKDKAGTFIGEYQFYTGNKPVLTLKEVDFRIRQTLIKNKKLYNGDYNKGHIKITGGSNNYTIDLSKRLKSTDANRYVKNPQTAHIEILLEKSS

SEQ ID NO: 35644 - protein, 238 aa, Staphylococcus aureus; identical to SEQ ID NO: 31240
  subsp. aureus 21345

SEQ ID NO: 35645 - protein, 942 aa, Staphylococcus aureus; identical to SEQ ID NO: 35550
  subsp. aureus 21345

SEQ ID NO: 35646 - protein, 1351 aa, Staphylococcus aureus; identical to SEQ ID NO: 31203
  subsp. aureus 21345

SEQ ID NO: 35647 - protein, 681 aa, Staphylococcus aureus; identical to SEQ ID NO: 34710
  subsp. aureus 21345

SEQ ID NO: 35648 - protein, 291 aa, Staphylococcus aureus; identical to SEQ ID NO: 30390
  subsp. aureus 21345

SEQ ID NO: 35649 - protein, 689 aa, Staphylococcus aureus; identical to SEQ ID NO: 31861
  subsp. aureus 21345

SEQ ID NO: 35650 - protein, 520 aa, Staphylococcus aureus
  subsp. aureus 21345
MEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSDSDSDSDSDSGKHTPVKPMSATKDHHNKAKALPETGSENNGSNNATLFGGLFAALGSLLLFGRRKKQ

SEQ ID NO: 35651 - protein, 290 aa, Staphylococcus aureus
  subsp. aureus 21345
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFE

SEQ ID NO: 35652 - protein, 434 aa, Staphylococcus aureus [sequence omitted]

SEQ ID NO: 35653 - protein, 1011 aa, Staphylococcus aureus
  subsp. aureus 21345
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 35654 - protein, 708 aa, Staphylococcus aureus
  subsp. aureus 21345
MESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSDISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 35655 - protein, 141 aa, Staphylococcus aureus; identical to SEQ ID NO: 31214
  subsp. aureus 21345

SEQ ID NO: 35656 - protein, 278 aa, Staphylococcus aureus; identical to SEQ ID NO: 34714
  subsp. aureus 21345

SEQ ID NO: 35657 - protein, 2189 aa, Staphylococcus aureus; identical to SEQ ID NO: 31236
  subsp. aureus 21345

SEQ ID NO: 35658 - protein, 331 aa, Staphylococcus aureus; identical to SEQ ID NO: 31235
  subsp. aureus 21345

SEQ ID NO: 35659 - protein, 806 aa, Staphylococcus aureus; identical to SEQ ID NO: 31234
  subsp. aureus 21345

SEQ ID NO: 35660 - protein, 258 aa, Staphylococcus aureus; identical to SEQ ID NO: 30518
  subsp. aureus 21345

SEQ ID NO: 35661 - protein, 165 aa, Staphylococcus aureus; identical to SEQ ID NO: 33973
  subsp. aureus 21345

SEQ ID NO: 35662 - protein, 261 aa, Staphylococcus aureus; identical to SEQ ID NO: 30506
  subsp. aureus 21345

SEQ ID NO: 35663 - protein, 242 aa, Staphylococcus aureus; identical to SEQ ID NO: 30522
  subsp. aureus 21345

SEQ ID NO: 35664 - protein, 239 aa, Staphylococcus aureus; identical to SEQ ID NO: 30171
  subsp. aureus 21345

SEQ ID NO: 35665 - protein, 254 aa, Staphylococcus aureus; identical to SEQ ID NO: 31226
  subsp. aureus 21345

SEQ ID NO: 35666 - protein, 112 aa, Staphylococcus aureus; identical to SEQ ID NO: 34751
  subsp. aureus 21345

SEQ ID NO: 35667 - protein, 206 aa, Staphylococcus aureus; identical to SEQ ID NO: 34750
  subsp. aureus 21345

SEQ ID NO: 35668 - protein, 165 aa, Staphylococcus aureus; identical to SEQ ID NO: 31241
  subsp. aureus 21345

SEQ ID NO: 35669 - protein, 105 aa, Staphylococcus aureus; identical to SEQ ID NO: 31168
  subsp. aureus 21345

SEQ ID NO: 35670 - protein, 354 aa, Staphylococcus aureus; identical to SEQ ID NO: 30412
  subsp. aureus 21345

SEQ ID NO: 35671 - protein, 652 aa, Staphylococcus aureus; identical to SEQ ID NO: 34746
  subsp. aureus 21345

SEQ ID NO: 35672 - protein, 802 aa, Staphylococcus aureus
  subsp. aureus 21345
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDS

SEQ ID NO: 35673 - protein, 1115 aa, Staphylococcus aureus
  subsp. aureus 21345
MISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLF

SEQ ID NO: 35674 - protein, 446 aa, Staphylococcus aureus
  subsp. aureus 21345
SGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSDSDSDSESDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 35675 - protein, 274 aa, Staphylococcus aureus; identical to SEQ ID NO: 35568
  subsp. aureus 21345

SEQ ID NO: 35676 - protein, 339 aa, Staphylococcus aureus; identical to SEQ ID NO: 31219
  subsp. aureus 21345

SEQ ID NO: 35677 - protein, 351 aa, Staphylococcus aureus; identical to SEQ ID NO: 31218
  subsp. aureus 21345

SEQ ID NO: 35678 - protein, 500 aa, Staphylococcus aureus
  subsp. aureus 21345
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35679 - protein, 221 aa, Staphylococcus aureus; identical to SEQ ID NO: 31036
  subsp. aureus 21345

SEQ ID NO: 35680 - protein, 321 aa, Staphylococcus aureus; identical to SEQ ID NO: 31900
  subsp. aureus 21345

SEQ ID NO: 35681 - protein, 315 aa, Staphylococcus aureus; identical to SEQ ID NO: 31191
  subsp. aureus 21345

SEQ ID NO: 35682 - protein, 325 aa, Staphylococcus aureus; identical to SEQ ID NO: 30479
  subsp. aureus 21345

SEQ ID NO: 35683 - protein, 372 aa, Staphylococcus aureus
  subsp. aureus 21345
MNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDMKISNTPKNSNQGNNLVVNNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVPSNNKSNSNNSTLNYLKTLENRGWDFDGSYGWQCFDLVNVYWNHLYGHGLKEYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 35684 - protein, 1183 aa, Staphylococcus aureus
  subsp. aureus 21345
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTAIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATVKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 35685 - protein, 2835 aa, Staphylococcus aureus
  subsp. aureus 21345
MNYRDKIQKFSIRKYTVGTFSTVIATLVFLGLNTSQAQAAETNQPASALKQKQQNGDTQTENREVEVQNSQNGQSLSAPIENEQPNNNQTNHVDASAVQSSTTEHDQPVSQNEQAKKDTAAATPTQSAKAASKHEQSESRAANKKENDNKATHVESHEANVVTASDSSDSGNVQHDRNELQAFFDANYHDYRFIDRENADSGTFNYVKGIFDKINTLLGSNDPINNKDLQLAYKELEQAVALIRTMPQRQQTSRRSSRIQTRSIESRAAEPRSVSDYQNANSSYYVENANDGSGYPVGTYINASSKGAPYNLPTTPWNTLKASDAKEIALITAKQTGDGYQWVIKFNKGHAPHENMIYWFALPAGQTPVGRTEFVTVNADGTNVQWSNGAGAGANKPLPEMWPYGVNDSRSWDYKIRNRSGQVIYDWPTVHINSLKDLARASDYFSEAGATPATKAFGRQTFEYINGERPTESPGVPKVYTFIGKGDASYTISFKTQGPTIDKLYYAAGGRALEYNQLFMYSQLYVESTQDYQQRLNGLRQVVNRTYRIGTTKRVEVSQGNVQTKKVLESTNLNIDDFMDDPLSYVKTPSNKVLGFYPTSANTNAFRPGGVNPLNEYQLSQLFTDDKLQQAARTGSPIRLMIGFDYPDAFGNGETLVPVNLTVLPEIQHNIKFFKNDDGQNIADKPASKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPRITTTAEELRGTALQKVPVTVTDIPLDPSALVYLVIPTSQTRDGGSEADQIPSGYTKIATGTPDGVHSTITIRPEDYVVFIPPVGNQIRALIFYNNVVASNMSNAVTILPDDIPPTINNPVGLNAKYYRGDEVSFTMGVSDRHSGLKSTTITTLPSGWTSNLTKSDKKNGSLAISGRVSMNQAYNSDITFKVSATDNVNNTTNDSQSKHVTVHVGKISDDAHPIVLGNSEKVVVVNPTALTGDEKQRITTAFMNKNQNIRGYLASSNPVTVDNHGNVTLQYRDGSSTTLDATNVMTYEPVVKPEYQTANAAKTATVTIAKGQSFNIGDIKQYFTLSNGQAIPSSSFTNITSDRTIPTAQEVSQMNAGTQLYHIVATNAYHKDTEDFYITLKIIDVKQPEGDQRVYRMSTYDITTDEISKVKQAFINANRDAISFAEGDISVTNTPNGSNVSTITVNINKGRLTKSFTSNLNNMNFLRWVNFPQDYTVTWTNAKIANRPTDGGLSWSDDHKSLIYRYDATLGTQITTNDILTLLKATTTVPGLRNNIAGNEKAQAEAGGRPNYKTTGYSQSNPTSDGQRQFTLNGQVIQIMDIINPSNGFGGQPVTNSNVRANHSNSTVVSVNESAANGAGAFTIDHVVKNNSTHNAADAVYKAQLYLSPYGPKQYVEHLNQNTDNTNEAINIYFVPSDLVNPTISVGNYTNHQVFSGETFTNTITANDNFGVQSVTVPTTSQLTGTVDNNHQHVSATAPNVTSTTNKTINLVATDTSGNTATTSFNVTIKPLRDKYRVGTSSTAANPVRIANISNNATVSQADQTAIINSLTFTSNAPNRNYATASANEITSKTVSNVSRTGNNAQVTVTVTYQDGTTSTVTVPVKRVIPEIVAHSHYTVQGQDFPTGNGASASDYFKLSNGSAIPDATITWVSGQAPNKNNTTIGQDINVTAHILIDGETTPITKTATYKVVRTVPKQVFETARGVLYPGVSDMYDAKQYVKPVNNSWSTNAQHMNFQFTNSYGPSKDVVGISTRDIRVTYDNHQTQIIKILSKVKPDPPRIDGNSVTYKAGLTNQQIKINNVLSSSSIKLFKADNTPLTITNTTYGSGNTAVVTVSDALPNGEIKARSSISMNNVTYTTQDEHGRAIDVTRNESVDSNDSASVHVTPQLQATTEGAVFIKGGDGFDFGHVERFIQNPPHGATVAWHDNPDTWKNTVGNTHKTAVVTLPNGQGTRNVEVPVKVYPVANAKAPSRDVKGQNLTNGTDAINYITFDPNTNTNGITAVWANRQQPNNQQAGVQHLNVDVTYPGISAAKRVPVTVNVYQFEFPQTSYTTTVGGTLASGTQASGYAHIQNATGLPTDGFTYKWNNAATGTNDANWAAMNKPNTAQVINAKYDVIYNGHTFATSLPAKFVVKDVQPAKPTVTETAAGVITIAPGANQTVNTHAGNVTTYADKLVIKRNGNVVTTFTRHNNTSPWVKEASAANVAGIAGTNNGITVAAGTFNPADTIQAVATQGSGETISDEQRSDDFTVVAPQPNQATTKIWQNGHVDITPNNPSGHLINPTQAMDIAYTEKVGNGAEHSKTLNAVRGQNNQWTIANKPDYVTLDAHTGKVTFNANTIKPNSAITITPKAGTGHSASSNPSTLTAPAAHTVNTTEIVKDYGSNVTAAEINNAVQVANKRTATIKNGTAMPTNLAGGSTTTIPVTVTYNDSSTEEVQESIFTKADKRELITAKNHLDDPVSTDGKKPGTITQYNNAIHNAQQQINTAKTEAQQVINDERATPQQVNAALSKVQAAQTKINEAKALLQNKEDNSQLVTSKNNLQSSVNQVPSTTGMTQQSIDNYNAKKREAESEITAAQRVIDNGDATAQQISDEKHRVDNALTALNQAKQNLTADTHELEQAVHQLNRTGTTTGKKPASITAYNNSIRALQSDLTSAKNSANAIIQKPIRSVQEVQTALTNVNRVNDRLTLAINQLVPLADNSALRTAKTKLDEEINKSVTTDGMTQSSIQAYENAKRAGQTESTNAQNVINNGDATDQQIAAKKLK

SEQ ID NO: 35686 - protein, 808 aa, Staphylococcus aureus; identical to SEQ ID NO: 31215
  subsp. aureus 55/2053

SEQ ID NO: 35687 - protein, 141 aa, Staphylococcus aureus; identical to SEQ ID NO: 31214
  subsp. aureus 55/2053

SEQ ID NO: 35688 - protein, 321 aa, Staphylococcus aureus; identical to SEQ ID NO: 31900
  subsp. aureus 55/2053

SEQ ID NO: 35689 - protein, 315 aa, Staphylococcus aureus; identical to SEQ ID NO: 31191
  subsp. aureus 55/2053

SEQ ID NO: 35690 - protein, 325 aa, Staphylococcus aureus; identical to SEQ ID NO: 30479
  subsp. aureus 55/2053

SEQ ID NO: 35691 - protein, 267 aa, Staphylococcus aureus
  subsp. aureus 55/2053
GPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 35692 - protein, 562 aa, Staphylococcus aureus
  subsp. aureus 55/2053
MKSNLRYGIRKHKLGAASVFLGTMIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEES

SEQ ID NO: 35693 - protein, 344 aa, Staphylococcus aureus
  subsp. aureus 55/2053
GPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPETPTPPTPEVPSEPETPTPPTPEVPSEPETPTPPTPEVPSEPGTPVPPTPEVPAEPGKPVPPAKDEPKKPSKPVEQGKVVTPVIEINEKVKAVAPTKQKQSKKSELPETGGEESTNKGMLFGGLFSILGLALLRRNKKNHKA

SEQ ID NO: 35694 - protein, 626 aa, Staphylococcus aureus
  subsp. aureus 55/2053
MHLKGDIIVKNNLRYGIRKHKLGAASVFLGTMIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEES

SEQ ID NO: 35695 - protein, 233 aa, Staphylococcus aureus; identical to SEQ ID NO: 31039
  subsp. aureus 55/2053

SEQ ID NO: 35696 - protein, 189 aa, Staphylococcus aureus
  subsp. aureus 55/2053
DSDSDSDSDSDSDSDSDSDSDSDSESDSDSDSDSDSDSDSDSDSDSDSDSDSDSDSDSDSESDSESDSDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 35697 - protein, 727 aa, Staphylococcus aureus
  subsp. aureus 55/2053
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDSD

SEQ ID NO: 35698 - protein, 1693 aa, Staphylococcus aureus
  subsp. aureus 55/2053
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSELLSESTSASTSESLSGSTSDSTSLSDSNSESGSTSTSLSNSTSSSTSISTSISGSASTSAYKSDSVSTSLSTSTSTSLSDSTSLSTSLSDSASGSKSNSLSASMSTSDSISTRKSESLSTSTSLSVSTSESESGSTSSSESKSDSTSMSLSMSQSISGSTSVSTSESLSDSTSTSLSLSASMNQSGVDSNSASQSASTSTSTSTSESDSQSTSSYTSQSTSQSESTSTSTSLSDSTSMSRSTSQSGSTSTSASLSASESESDSQSISTSASDSTSESTSTSLSDSTSTSNSTSESTSKAISTSASASESDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 35699 - protein, 681 aa, Staphylococcus aureus; identical to SEQ ID NO: 31046
  subsp. aureus 55/2053

SEQ ID NO: 35700 - protein, 88 aa, Staphylococcus aureus
  subsp. aureus 55/2053
PNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 35701 - protein, 581 aa, Staphylococcus aureus
  subsp. aureus 55/2053
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKY

SEQ ID NO: 35702 - protein, 453 aa, Staphylococcus aureus
  subsp. aureus 55/2053
MTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35703 - protein, 221 aa, Staphylococcus aureus; identical to SEQ ID NO: 31036
  subsp. aureus 55/2053

SEQ ID NO: 35704 - protein, 691 aa, Staphylococcus aureus; identical to SEQ ID NO: 31040
  subsp. aureus 55/2053

SEQ ID NO: 35705 - protein, 226 aa, Staphylococcus aureus; identical to SEQ ID NO: 31265
  subsp. aureus 55/2053

SEQ ID NO: 35706 - protein, 231 aa, Staphylococcus aureus
  subsp. aureus 55/2053
MKSIAKVSLVLGILATGVNTVTEQPVHAENKHVQVSQNSKNLKAYYTQPSVEYKNVTGYISSIQPKPGTKFLNMIEGNTVNNLALVGKDKEHYHTGVHRNLDIFYVNEDKRFEGAKYSIGGITKASDKVVDQVAEARVIKEDHTGEYDYDFFPFKIDKEAMTLKEVDFKIRKHLIDHYGLYGEMSSGTVTVQMKYYGKYTIELDKKLQEDRMADIVKVIDIDRIEVKVKKA

SEQ ID NO: 35707 - protein, 343 aa, Staphylococcus aureus; identical to SEQ ID NO: 31263
  subsp. aureus 55/2053

SEQ ID NO: 35708 - protein, 304 aa, Staphylococcus aureus
  subsp. aureus 55/2053
MKMTQIAKTSLALSLLTTGASIVTTQSANAEVASALKTEQAIKSKIQKVTTSPSTKVKATQPTPSVTTPPSPNVQPQSPQPTPNPTTPHSSNVETKQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSITKKDEKGKISHDDSEYKITKEEISLKELDFKLRKQLIEQHNLYGNIGSGTIVIKTKNGGKYTFELHKKLQEHRMADVIDGTSIERIEVNLKSS

SEQ ID NO: 35709 - protein, 234 aa, Staphylococcus aureus; identical to SEQ ID NO: 30567
  subsp. aureus 55/2053

SEQ ID NO: 35710 - protein, 231 aa, Staphylococcus aureus; identical to SEQ ID NO: 30566
  subsp. aureus 55/2053

SEQ ID NO: 35711 - protein, 232 aa, Staphylococcus aureus; identical to SEQ ID NO: 30565
  subsp. aureus 55/2053

SEQ ID NO: 35712 - protein, 227 aa, Staphylococcus aureus; identical to SEQ ID NO: 30564
  subsp. aureus 55/2053

SEQ ID NO: 35713 - protein, 232 aa, Staphylococcus aureus; identical to SEQ ID NO: 31257
  subsp. aureus 55/2053

SEQ ID NO: 35714 - protein, 649 aa, Staphylococcus aureus
  subsp. aureus 55/2053
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYDNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYR

SEQ ID NO: 35715 - protein, 96 aa, Staphylococcus aureus
  subsp. aureus 55/2053
SESDSDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 35716 - protein, 1037 aa, Staphylococcus aureus
  subsp. aureus 55/2053
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLN

SEQ ID NO: 35717 - protein, 114 aa, Staphylococcus aureus
  subsp. aureus 55/2053
SDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 35718 - protein, 858 aa, Staphylococcus aureus
  subsp. aureus 55/2053
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPDEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQN

SEQ ID NO: 35719 - protein, 106 aa, Staphylococcus aureus
  subsp. aureus 55/2053
SDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 35720 - protein, 434 aa, Staphylococcus aureus [sequence omitted]

SEQ ID NO: 35721 - protein, 1005 aa, Staphylococcus aureus
  subsp. aureus 55/2053
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 35722 - protein, 648 aa, Staphylococcus aureus; identical to SEQ ID NO: 31909
  subsp. aureus 55/2053

SEQ ID NO: 35723 - protein, 354 aa, Staphylococcus aureus; identical to SEQ ID NO: 30412
  subsp. aureus 55/2053

SEQ ID NO: 35724 - protein, 105 aa, Staphylococcus aureus; identical to SEQ ID NO: 31168
  subsp. aureus 55/2053

SEQ ID NO: 35725 - protein, 165 aa, Staphylococcus aureus; identical to SEQ ID NO: 31241
  subsp. aureus 55/2053

SEQ ID NO: 35726 - protein, 319 aa, Staphylococcus aureus; identical to SEQ ID NO: 33985
  subsp. aureus 55/2053

SEQ ID NO: 35727 - protein, 328 aa, Staphylococcus aureus
  subsp. aureus 55/2053
MKKIVKSSVVTSIALLLLSNTVDAAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETINYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQREMDRYTNFWNQLHWIGNNYKDENRATHTSIYEVDWENHTVKLIDTQSKEKKSYELNR

SEQ ID NO: 35728 - protein, 315 aa, Staphylococcus aureus
  subsp. aureus 55/2053
MIFMVKKRLLAATLSLGIITPIATSFHESKADNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVEHQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 35729 - protein, 238 aa, Staphylococcus aureus; identical to SEQ ID NO: 31240
  subsp. aureus 55/2053

SEQ ID NO: 35730 - protein, 241 aa, Staphylococcus aureus; identical to SEQ ID NO: 31239
  subsp. aureus 55/2053

SEQ ID NO: 35731 - protein, 241 aa, Staphylococcus aureus; identical to SEQ ID NO: 31173
  subsp. aureus 55/2053

SEQ ID NO: 35732 - protein, 176 aa, Staphylococcus aureus
  subsp. aureus 55/2053
MNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDMKISNTPKNSNQGNNLVVNNNEPTKEIKIANLEAQNSNQKKVNKGTNNYFGYYSFREAPKTQIYTVKKVTHLVL

SEQ ID NO: 35733 - protein, 151 aa, Staphylococcus aureus
  subsp. aureus 55/2053
MLEGIFTNSASAIEYSDLHHKSKLDSKRLYNAKVSFANPTDLENKKTNDRLLKHDLLFHDMFLNDAWKKDLKVEFENEALSKKFINKNIDVYAGSYSYECHGGETNKTQCSYGGVTLSDNNKYDDYKNIPCNLWIDGHQTEIELTAVKTKK

SEQ ID NO: 35734 - protein, 291 aa, Staphylococcus aureus; identical to SEQ ID NO: 30390
  subsp. aureus 55/2053

SEQ ID NO: 35735 - protein, 890 aa, Staphylococcus aureus
  subsp. aureus 55/2053
MNKHHPKLRSFYSIRKSTLGVASVIVSTLFLITSQHQAQAAENTNTSDKISENQNNNATTTQPPKDTNQTQPATQPTNTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNTSNQNTSTTNNTNDQPQATNNMSQPAQPKASANSDQASSQPAHETNSNDNTNDVTNASSNQSNGNQQYPPADESLQDAIKNPAIIDKEHTADHWRPIDFQMKNDKGERQFYHYASTVEPATVIFTKTGPIIELGLKTASTWKKFEVYEGDKKLPVELVSYDSDKDYAYIRFPVSNGAREVKIVSSIEYGENFHEDYDYTLMVFAQPITNNPDDYVDEETYNLQKLLAPYHKAKTLERQVYELEKLQDKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDPKNNSRTLIFPYVPDKAIYNAIVKVVVANIGYEGQYHVRIVNQDIKTKDDDTSQNNTIEPLNVQTGQEDKVTATDTAENSSTATNPKDASDKADVIEPESDVVKDADSSVDKDVQNDVDHLSDMSDNTHLDKYDFKEMDTQIAKDTDKGVDNSLGMTSNVDTDKDSNKNEGKVIQLAHNTDKNHTGKAAKLDGVRQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 35736 - protein, 2035 aa, Staphylococcus aureus
  subsp. aureus 55/2053
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPASLAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMVDEDATLNDIKKHTQFIIDEILAIKLPAEVIKASPKVGQPAPKVCTPIKKEDKQEVRKVVKELPNTGSEEMDLPLKELALITGAALLARRRSKKEKES

SEQ ID NO: 35737 - protein, 331 aa, Staphylococcus aureus; identical to SEQ ID NO: 31235
  subsp. aureus 55/2053

SEQ ID NO: 35738 - protein, 808 aa, Staphylococcus aureus
  subsp. aureus 55/2053
MSMTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAEAMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVTNSNDAGVNFELTK

SEQ ID NO: 35739 - protein, 258 aa, Staphylococcus aureus; identical to SEQ ID NO: 30518
  subsp. aureus 55/2053

SEQ ID NO: 35740 - protein, 251 aa, Staphylococcus aureus; identical to SEQ ID NO: 30505
  subsp. aureus 55/2053

SEQ ID NO: 35741 - protein, 261 aa, Staphylococcus aureus; identical to SEQ ID NO: 30506
  subsp. aureus 55/2053

SEQ ID NO: 35742 - protein, 242 aa, Staphylococcus aureus; identical to SEQ ID NO: 30522
  subsp. aureus 55/2053

SEQ ID NO: 35743 - protein, 239 aa, Staphylococcus aureus
  subsp. aureus 55/2053
MKRILIIVVLLFCYSQNHIATANVGVLNLRNYYGSYPIEDHQNINPDNNRLSHQLVFSKDNSTVTAEFKNVEDVKKFKNRAVDVYGLSYSGYCLKNKYMYGGVTLAGDYLEKSRCIPINLWVNGNLKTISTDKVSTNKKIVTAQEIDTKLRRYLQEEYNIYGFNDTNKGRNYGTKSKFFSGFNTGKISFHLNDGTSFSYDLFDTGTGQAESFLKIYNDNKTVETDKFHLDVEISYKDES

SEQ ID NO: 35744 - protein, 254 aa, Staphylococcus aureus; identical to SEQ ID NO: 31226
  subsp. aureus 55/2053

SEQ ID NO: 35745 - protein, 689 aa, Staphylococcus aureus; identical to SEQ ID NO: 31861
  subsp. aureus 55/2053

SEQ ID NO: 35746 - protein, 274 aa, Staphylococcus aureus; identical to SEQ ID NO: 33993
  subsp. aureus 55/2053

SEQ ID NO: 35747 - protein, 339 aa, Staphylococcus aureus; identical to SEQ ID NO: 31219
  subsp. aureus 55/2053

SEQ ID NO: 35748 - protein, 351 aa, Staphylococcus aureus; identical to SEQ ID NO: 33991
  subsp. aureus 55/2053

SEQ ID NO: 35749 - protein, 231 aa, Staphylococcus aureus; identical to SEQ ID NO: 31216
  subsp. aureus 55/2053

SEQ ID NO: 35750 - protein, 40 aa, Staphylococcus aureus; identical to SEQ ID NO: 31854
  subsp. aureus 55/2053

SEQ ID NO: 35751 - protein, 808 aa, Staphylococcus aureus; identical to SEQ ID NO: 31215
  subsp. aureus 58-424

SEQ ID NO: 35752 - protein, 141 aa, Staphylococcus aureus; identical to SEQ ID NO: 31214
  subsp. aureus 58-424

SEQ ID NO: 35753 - protein, 321 aa, Staphylococcus aureus; identical to SEQ ID NO: 31900
  subsp. aureus 58-424

SEQ ID NO: 35754 - protein, 315 aa, Staphylococcus aureus; identical to SEQ ID NO: 31191
  subsp. aureus 58-424

SEQ ID NO: 35755 - protein, 325 aa, Staphylococcus aureus; identical to SEQ ID NO: 30479
  subsp. aureus 58-424

SEQ ID NO: 35756 - protein, 69 aa, Staphylococcus aureus
  subsp. aureus 58-424
MEQGKVVTPVIEINEKVKAVAPTKQKQSKKSELPETGGEESTNKGMLFGGLFSILGLALLRRNKKNHKA

SEQ ID NO: 35757 - protein, 886 aa, Staphylococcus aureus
  subsp. aureus 58-424
MIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNIGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 35758 - protein, 1036 aa, Staphylococcus aureus
  subsp. aureus 58-424
MKNNLRYGIRKHKLGAASVFLGTMIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGVVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPETPTPPTPEVPSEPETPTPPTPEVPSEPETPTPPTPEVPSEPGTPVPPTPEVPAEPGKPVPPAKDEPKKPSKPVEQGKVVTPVIEINEKVKAVAPTKQKQSKKSELPETGGEESTNKGMLFGGLFSILGLALLRRN

SEQ ID NO: 35759 - protein, 233 aa, Staphylococcus aureus; identical to SEQ ID NO: 31039
  subsp. aureus 58-424

SEQ ID NO: 35760 - protein, 684 aa, Staphylococcus aureus
  subsp. aureus 58-424
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDS

SEQ ID NO: 35761 - protein, 91 aa, Staphylococcus aureus
  subsp. aureus 58-424
MSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 35762 - protein, 681 aa, Staphylococcus aureus; identical to SEQ ID NO: 31046
  subsp. aureus 58-424

SEQ ID NO: 35763 - protein, 670 aa, Staphylococcus aureus
  subsp. aureus 58-424
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNW

SEQ ID NO: 35764 - protein, 453 aa, Staphylococcus aureus; identical to SEQ ID NO: 35702
  subsp. aureus 58-424

SEQ ID NO: 35765 - protein, 221 aa, Staphylococcus aureus; identical to SEQ ID NO: 31036
  subsp. aureus 58-424

SEQ ID NO: 35766 - protein, 691 aa, Staphylococcus aureus; identical to SEQ ID NO: 31040
  subsp. aureus 58-424

SEQ ID NO: 35767 - protein, 226 aa, Staphylococcus aureus; identical to SEQ ID NO: 31265
  subsp. aureus 58-424

SEQ ID NO: 35768 - protein, 231 aa, Staphylococcus aureus; identical to SEQ ID NO: 35706
  subsp. aureus 58-424

SEQ ID NO: 35769 - protein, 343 aa, Staphylococcus aureus; identical to SEQ ID NO: 31263
  subsp. aureus 58-424

SEQ ID NO: 35770 - protein, 304 aa, Staphylococcus aureus; identical to SEQ ID NO: 35708
  subsp. aureus 58-424

SEQ ID NO: 35771 - protein, 234 aa, Staphylococcus aureus; identical to SEQ ID NO: 30567
  subsp. aureus 58-424

SEQ ID NO: 35772 - protein, 231 aa, Staphylococcus aureus; identical to SEQ ID NO: 30566
  subsp. aureus 58-424

SEQ ID NO: 35773 - protein, 232 aa, Staphylococcus aureus; identical to SEQ ID NO: 30565
  subsp. aureus 58-424

SEQ ID NO: 35774 - protein, 227 aa, Staphylococcus aureus; identical to SEQ ID NO: 30564
  subsp. aureus 58-424

SEQ ID NO: 35775 - protein, 232 aa, Staphylococcus aureus; identical to SEQ ID NO: 31257
  subsp. aureus 58-424

SEQ ID NO: 35776 - protein, 796 aa, Staphylococcus aureus
  subsp. aureus 58-424
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYDNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSESDSDSESDSDSDSDSDSDSDSDSDSDSDSESDSDSDSDSD

SEQ ID NO: 35777 - protein, 54 aa, Staphylococcus aureus
  subsp. aureus 58-424
MKPMSATKDHHNKAKALPETGSENNGSNNATLFGGLFAALGSLLLFGRRKKQNK

SEQ ID NO: 35778 - protein, 1356 aa, Staphylococcus aureus
  subsp. aureus 58-424
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 35779 - protein, 1007 aa, Staphylococcus aureus
  subsp. aureus 58-424
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPDEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSD

SEQ ID NO: 35780 - protein, 434 aa, Staphylococcus aureus [sequence omitted]

SEQ ID NO: 35781 - protein, 724 aa, Staphylococcus aureus
  subsp. aureus 58-424
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSE

SEQ ID NO: 35782 - protein, 62 aa, Staphylococcus aureus
  subsp. aureus 58-424
MPPNSPKSGTNASNKNEAKESKEPLPDTGSEDEANTSLIWGLLASLGSLLLFRRKKENKDKK

SEQ ID NO: 35783 - protein, 648 aa, Staphylococcus aureus; identical to SEQ ID NO: 31909
  subsp. aureus 58-424

SEQ ID NO: 35784 - protein, 354 aa, Staphylococcus aureus; identical to SEQ ID NO: 30412
  subsp. aureus 58-424

SEQ ID NO: 35785 - protein, 105 aa, Staphylococcus aureus; identical to SEQ ID NO: 31168
  subsp. aureus 58-424

SEQ ID NO: 35786 - protein, 165 aa, Staphylococcus aureus; identical to SEQ ID NO: 31241
  subsp. aureus 58-424

SEQ ID NO: 35787 - protein, 319 aa, Staphylococcus aureus; identical to SEQ ID NO: 33985
  subsp. aureus 58-424

SEQ ID NO: 35788 - protein, 238 aa, Staphylococcus aureus; identical to SEQ ID NO: 31240
  subsp. aureus 58-424

SEQ ID NO: 35789 - protein, 241 aa, Staphylococcus aureus; identical to SEQ ID NO: 31239
  subsp. aureus 58-424

SEQ ID NO: 35790 - protein, 241 aa, Staphylococcus aureus; identical to SEQ ID NO: 31173
  subsp. aureus 58-424

SEQ ID NO: 35791 - protein, 176 aa, Staphylococcus aureus; identical to SEQ ID NO: 35732
  subsp. aureus 58-424

SEQ ID NO: 35792 - protein, 325 aa, Staphylococcus aureus; identical to SEQ ID NO: 30484
  subsp. aureus 58-424

SEQ ID NO: 35793 - protein, 315 aa, Staphylococcus aureus; identical to SEQ ID NO: 35728
  subsp. aureus 58-424

SEQ ID NO: 35794 - protein, 151 aa, Staphylococcus aureus; identical to SEQ ID NO: 35733
  subsp. aureus 58-424

SEQ ID NO: 35795 - protein, 291 aa, Staphylococcus aureus; identical to SEQ ID NO: 30390
  subsp. aureus 58-424

SEQ ID NO: 35796 - protein, 890 aa, Staphylococcus aureus; identical to SEQ ID NO: 35735
  subsp. aureus 58-424

SEQ ID NO: 35797 - protein, 2035 aa, Staphylococcus aureus; identical to SEQ ID NO: 35736
  subsp. aureus 58-424

SEQ ID NO: 35798 - protein, 331 aa, Staphylococcus aureus; identical to SEQ ID NO: 31235
  subsp. aureus 58-424

SEQ ID NO: 35799 - protein, 664 aa, Staphylococcus aureus
  subsp. aureus 58-424
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAEAMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKR

SEQ ID NO: 35800 - protein, 258 aa, Staphylococcus aureus; identical to SEQ ID NO: 30518
  subsp. aureus 58-424

SEQ ID NO: 35801 - protein, 251 aa, Staphylococcus aureus; identical to SEQ ID NO: 30505
  subsp. aureus 58-424

SEQ ID NO: 35802 - protein, 261 aa, Staphylococcus aureus; identical to SEQ ID NO: 30506
  subsp. aureus 58-424

SEQ ID NO: 35803 - protein, 242 aa, Staphylococcus aureus; identical to SEQ ID NO: 30522
  subsp. aureus 58-424

SEQ ID NO: 35804 - protein, 239 aa, Staphylococcus aureus; identical to SEQ ID NO: 35743
  subsp. aureus 58-424

SEQ ID NO: 35805 - protein, 254 aa, Staphylococcus aureus; identical to SEQ ID NO: 31226
  subsp. aureus 58-424

SEQ ID NO: 35806 - protein, 689 aa, Staphylococcus aureus; identical to SEQ ID NO: 31861
  subsp. aureus 58-424

SEQ ID NO: 35807 - protein, 274 aa, Staphylococcus aureus; identical to SEQ ID NO: 33993
  subsp. aureus 58-424

SEQ ID NO: 35808 - protein, 339 aa, Staphylococcus aureus; identical to SEQ ID NO: 31219
  subsp. aureus 58-424

SEQ ID NO: 35809 - protein, 351 aa, Staphylococcus aureus
  subsp. aureus 58-424
MKNKKRVFIASSLSCALLLLSAANTEANSANKDSQDQTKKEHVDKAQQKEKRNVNDKDKNTPGSDDIGKNGKVTKRTVSEYDKETNILQNLQFDFIDDPTYDKNVLLVKKQGSIHSNLKFESHRNETNASWLKYPSEYHVDFQVQRNPKTEILDQLPKNKISTAKVDSTFSYSLGGKFDSTKGIGRTSSNSYSKSISYNQQNYDTIASGKNNNRHVHWSVVANDLKYGNEIKNRNDEFLFYRNTRLSTVENPELSFASKYRYPALVRSGFNPEFLTYISNEKSNEKTRFEVTYTRNQDILKNKPGIHYGQPILEQNKDGQRFIVVYEVDWKNKTVKVVEKYSDQNKPYKEG

SEQ ID NO: 35810 - protein, 231 aa, Staphylococcus aureus; identical to SEQ ID NO: 31216
  subsp. aureus 58-424

SEQ ID NO: 35811 - protein, 286 aa, Staphylococcus aureus
  subsp. aureus 58-424
FKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATVKTATLNESNNWTHTWTGLDEKA

SEQ ID NO: 35812 - protein, 808 aa, Staphylococcus aureus; identical to SEQ ID NO: 31215
  subsp. aureus 65-1322

SEQ ID NO: 35813 - protein, 141 aa, Staphylococcus aureus; identical to SEQ ID NO: 31214
  subsp. aureus 65-1322

SEQ ID NO: 35814 - protein, 321 aa, Staphylococcus aureus; identical to SEQ ID NO: 31900
  subsp. aureus 65-1322

SEQ ID NO: 35815 - protein, 315 aa, Staphylococcus aureus; identical to SEQ ID NO: 31191
  subsp. aureus 65-1322

SEQ ID NO: 35816 - protein, 325 aa, Staphylococcus aureus; identical to SEQ ID NO: 30479
  subsp. aureus 65-1322

SEQ ID NO: 35817 - protein, 886 aa, Staphylococcus aureus; identical to SEQ ID NO: 35757
  subsp. aureus 65-1322

SEQ ID NO: 35818 - protein, 1019 aa, Staphylococcus aureus
  subsp. aureus 65-1322
MIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGVVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPETPTPPTPEVPSEPETPTPPTPEVPSEPETPTPPTPEVPSEPGTPVPPTPEVPAEPGKPVPPAKDEPKKPSKPVEQGKVVTPVIEINEKVKAVAPTKQKQSKKSELPETGGEESTNKGMLFGGLFSILGLALLRRNKKNHKA

SEQ ID NO: 35819 - protein, 233 aa, Staphylococcus aureus; identical to SEQ ID NO: 31039
  subsp. aureus 65-1322

SEQ ID NO: 35820 - protein, 885 aa, Staphylococcus aureus
  subsp. aureus 65-1322
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 35821 - protein, 1731 aa, Staphylococcus aureus
  subsp. aureus 65-1322
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSELLSESTSASTSESLSGSTSDSTSLSDSNSESGSTSTSLSNSTSSSTSISTSISGSASTSAYKSDSVSTSLSTSTSTSLSDSTSLSTSLSDSASGSKSNSLSASMSTSDSISTRKSESLSTSTSLSVSTSESESGSTSSSESKSDSTSMSLSMSQSISGSTSVSTSESLSDSTSTSLSLSASMNQSGVDSNSASQSASTSTSTSTSESDSQSTSSYTSQSTSQSESTSTSTSLSDSTSMSRSTSQSGSTSTSASLSASESESDSQSISTSASDSTSESTSTSLSDSTSTSNSTSESTSKAISTSASASESDSSSTSLSDSTSASMQSSESDSQSTSASGSTSESTSESDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 35822 - protein, 681 aa, Staphylococcus aureus; identical to SEQ ID NO: 31046
  subsp. aureus 65-1322

SEQ ID NO: 35823 - protein, 107 aa, Staphylococcus aureus
  subsp. aureus 65-1322
MDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 35824 - protein, 582 aa, Staphylococcus aureus
  subsp. aureus 65-1322
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYK

SEQ ID NO: 35825 - protein, 453 aa, Staphylococcus aureus; identical to SEQ ID NO: 35702
  subsp. aureus 65-1322

SEQ ID NO: 35826 - protein, 221 aa, Staphylococcus aureus; identical to SEQ ID NO: 31036
  subsp. aureus 65-1322

SEQ ID NO: 35827 - protein, 691 aa, Staphylococcus aureus; identical to SEQ ID NO: 31040
  subsp. aureus 65-1322

SEQ ID NO: 35828 - protein, 226 aa, Staphylococcus aureus; identical to SEQ ID NO: 31265
  subsp. aureus 65-1322

SEQ ID NO: 35829 - protein, 231 aa, Staphylococcus aureus; identical to SEQ ID NO: 35706
  subsp. aureus 65-1322

SEQ ID NO: 35830 - protein, 343 aa, Staphylococcus aureus; identical to SEQ ID NO: 31263
  subsp. aureus 65-1322

SEQ ID NO: 35831 - protein, 304 aa, Staphylococcus aureus; identical to SEQ ID NO: 35708
  subsp. aureus 65-1322

SEQ ID NO: 35832 - protein, 234 aa, Staphylococcus aureus; identical to SEQ ID NO: 30567
  subsp. aureus 65-1322

SEQ ID NO: 35833 - protein, 231 aa, Staphylococcus aureus; identical to SEQ ID NO: 30566
  subsp. aureus 65-1322

SEQ ID NO: 35834 - protein, 232 aa, Staphylococcus aureus; identical to SEQ ID NO: 30565
  subsp. aureus 65-1322

SEQ ID NO: 35835 - protein, 227 aa, Staphylococcus aureus; identical to SEQ ID NO: 30564
  subsp. aureus 65-1322

SEQ ID NO: 35836 - protein, 232 aa, Staphylococcus aureus; identical to SEQ ID NO: 31257
  subsp. aureus 65-1322

SEQ ID NO: 35837 - protein, 651 aa, Staphylococcus aureus
  subsp. aureus 65-1322
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYDNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFD

SEQ ID NO: 35838 - protein, 54 aa, Staphylococcus aureus; identical to SEQ ID NO: 35777
  subsp. aureus 65-1322

SEQ ID NO: 35839 - protein, 1037 aa, Staphylococcus aureus; identical to SEQ ID NO: 35716
  subsp. aureus 65-1322

SEQ ID NO: 35840 - protein, 234 aa, Staphylococcus aureus
  subsp. aureus 65-1322
SDSDSESDSDSDSESDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 35841 - protein, 858 aa, Staphylococcus aureus; identical to SEQ ID NO: 35718
  subsp. aureus 65-1322

SEQ ID NO: 35842 - protein, 212 aa, Staphylococcus aureus
  subsp. aureus 65-1322
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 35843 - protein, 434 aa, Staphylococcus aureus [sequence omitted]

SEQ ID NO: 35844 - protein, 1005 aa, Staphylococcus aureus; identical to SEQ ID NO: 35721
  subsp. aureus 65-1322

SEQ ID NO: 35845 - protein, 319 aa, Staphylococcus aureus; identical to SEQ ID NO: 33985
  subsp. aureus 65-1322

SEQ ID NO: 35846 - protein, 238 aa, Staphylococcus aureus; identical to SEQ ID NO: 31240
  subsp. aureus 65-1322

SEQ ID NO: 35847 - protein, 241 aa, Staphylococcus aureus; identical to SEQ ID NO: 31239
  subsp. aureus 65-1322

SEQ ID NO: 35848 - protein, 241 aa, Staphylococcus aureus; identical to SEQ ID NO: 31173
  subsp. aureus 65-1322

SEQ ID NO: 35849 - protein, 176 aa, Staphylococcus aureus; identical to SEQ ID NO: 35732
  subsp. aureus 65-1322

SEQ ID NO: 35850 - protein, 68 aa, Staphylococcus aureus
  subsp. aureus 65-1322
MNEKYKLYEQGGDIVKGYVKYHNDDEKNVEYDFYNLNGEYGHEVLKMYADNKTINSDKLHLDIYLFKS

SEQ ID NO: 35851 - protein, 167 aa, Staphylococcus aureus; identical to SEQ ID NO: 31885
  subsp. aureus 65-1322

SEQ ID NO: 35852 - protein, 291 aa, Staphylococcus aureus; identical to SEQ ID NO: 30390
  subsp. aureus 65-1322

SEQ ID NO: 35853 - protein, 127 aa, Staphylococcus aureus
  subsp. aureus 65-1322
MNKHHPKLRSFYSIRKSTLGVASVIVSTLFLITSQHQAQAAENTNTSDKISENQNNNATTTQPPKDTNQTQPATQPTNTAKTYPAADESLKDAIKNPAVENKEHDIGPREQVNFQLLDKNNETQYYH

SEQ ID NO: 35854 - protein, 2035 aa, Staphylococcus aureus; identical to SEQ ID NO: 35736
  subsp. aureus 65-1322

SEQ ID NO: 35855 - protein, 331 aa, Staphylococcus aureus; identical to SEQ ID NO: 31235
  subsp. aureus 65-1322

SEQ ID NO: 35856 - protein, 808 aa, Staphylococcus aureus; identical to SEQ ID NO: 35738
  subsp. aureus 65-1322

SEQ ID NO: 35857 - protein, 258 aa, Staphylococcus aureus; identical to SEQ ID NO: 30518
  subsp. aureus 65-1322

SEQ ID NO: 35858 - protein, 251 aa, Staphylococcus aureus; identical to SEQ ID NO: 30505
  subsp. aureus 65-1322

SEQ ID NO: 35859 - protein, 261 aa, Staphylococcus aureus; identical to SEQ ID NO: 30506
  subsp. aureus 65-1322

SEQ ID NO: 35860 - protein, 242 aa, Staphylococcus aureus; identical to SEQ ID NO: 30522
  subsp. aureus 65-1322

SEQ ID NO: 35861 - protein, 239 aa, Staphylococcus aureus; identical to SEQ ID NO: 35743
  subsp. aureus 65-1322

SEQ ID NO: 35862 - protein, 254 aa, Staphylococcus aureus; identical to SEQ ID NO: 31226
  subsp. aureus 65-1322

SEQ ID NO: 35863 - protein, 648 aa, Staphylococcus aureus; identical to SEQ ID NO: 31909
  subsp. aureus 65-1322

SEQ ID NO: 35864 - protein, 354 aa, Staphylococcus aureus; identical to SEQ ID NO: 30412
  subsp. aureus 65-1322

SEQ ID NO: 35865 - protein, 105 aa, Staphylococcus aureus; identical to SEQ ID NO: 31168
  subsp. aureus 65-1322

SEQ ID NO: 35866 - protein, 689 aa, Staphylococcus aureus; identical to SEQ ID NO: 31861
  subsp. aureus 65-1322

SEQ ID NO: 35867 - protein, 274 aa, Staphylococcus aureus; identical to SEQ ID NO: 33993
  subsp. aureus 65-1322

SEQ ID NO: 35868 - protein, 339 aa, Staphylococcus aureus; identical to SEQ ID NO: 31219
  subsp. aureus 65-1322

SEQ ID NO: 35869 - protein, 351 aa, Staphylococcus aureus; identical to SEQ ID NO: 33991
  subsp. aureus 65-1322

SEQ ID NO: 35870 - protein, 231 aa, Staphylococcus aureus; identical to SEQ ID NO: 31216
  subsp. aureus 65-1322

SEQ ID NO: 35871 - protein, 40 aa, Staphylococcus aureus; identical to SEQ ID NO: 31854
  subsp. aureus 65-1322

SEQ ID NO: 35872 - protein, 233 aa, Staphylococcus aureus; identical to SEQ ID NO: 31039
  subsp. aureus 68-397

SEQ ID NO: 35873 - protein, 1731 aa, Staphylococcus aureus; identical to SEQ ID NO: 35821
  subsp. aureus 68-397

SEQ ID NO: 35874 - protein, 681 aa, Staphylococcus aureus; identical to SEQ ID NO: 31046
  subsp. aureus 68-397

SEQ ID NO: 35875 - protein, 582 aa, Staphylococcus aureus; identical to SEQ ID NO: 35824
  subsp. aureus 68-397

SEQ ID NO: 35876 - protein, 430 aa, Staphylococcus aureus
  subsp. aureus 68-397
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35877 - protein, 221 aa, Staphylococcus aureus; identical to SEQ ID NO: 31036
  subsp. aureus 68-397

SEQ ID NO: 35878 - protein, 691 aa, Staphylococcus aureus; identical to SEQ ID NO: 31040
  subsp. aureus 68-397

SEQ ID NO: 35879 - protein, 226 aa, Staphylococcus aureus; identical to SEQ ID NO: 31265
  subsp. aureus 68-397

SEQ ID NO: 35880 - protein, 231 aa, Staphylococcus aureus; identical to SEQ ID NO: 35706
  subsp. aureus 68-397

SEQ ID NO: 35881 - protein, 343 aa, Staphylococcus aureus; identical to SEQ ID NO: 31263
  subsp. aureus 68-397

SEQ ID NO: 35882 - protein, 304 aa, Staphylococcus aureus; identical to SEQ ID NO: 35708
  subsp. aureus 68-397

SEQ ID NO: 35883 - protein, 234 aa, Staphylococcus aureus; identical to SEQ ID NO: 30567
  subsp. aureus 68-397

SEQ ID NO: 35884 - protein, 231 aa, Staphylococcus aureus; identical to SEQ ID NO: 30566
  subsp. aureus 68-397

SEQ ID NO: 35885 - protein, 232 aa, Staphylococcus aureus; identical to SEQ ID NO: 30565
  subsp. aureus 68-397

SEQ ID NO: 35886 - protein, 227 aa, Staphylococcus aureus; identical to SEQ ID NO: 30564
  subsp. aureus 68-397

SEQ ID NO: 35887 - protein, 232 aa, Staphylococcus aureus; identical to SEQ ID NO: 31257
  subsp. aureus 68-397

SEQ ID NO: 35888 - protein, 810 aa, Staphylococcus aureus
  subsp. aureus 68-397
MSMTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSDISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 35889 - protein, 141 aa, Staphylococcus aureus; identical to SEQ ID NO: 31214
  subsp. aureus 68-397

SEQ ID NO: 35890 - protein, 321 aa, Staphylococcus aureus; identical to SEQ ID NO: 31900
  subsp. aureus 68-397

SEQ ID NO: 35891 - protein, 315 aa, Staphylococcus aureus; identical to SEQ ID NO: 31191
  subsp. aureus 68-397

SEQ ID NO: 35892 - protein, 325 aa, Staphylococcus aureus; identical to SEQ ID NO: 30479
  subsp. aureus 68-397

SEQ ID NO: 35893 - protein, 909 aa, Staphylococcus aureus
  subsp. aureus 68-397
MKSNLRYGIRKHKLGAASVFLGTMIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNIGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 35894 - protein, 1019 aa, Staphylococcus aureus; identical to SEQ ID NO: 35818
  subsp. aureus 68-397

SEQ ID NO: 35895 - protein, 54 aa, Staphylococcus aureus; identical to SEQ ID NO: 35777
  subsp. aureus 68-397

SEQ ID NO: 35896 - protein, 434 aa, Staphylococcus aureus [sequence omitted]

SEQ ID NO: 35897 - protein, 553 aa, Staphylococcus aureus
  subsp. aureus 68-397
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGE

SEQ ID NO: 35898 - protein, 62 aa, Staphylococcus aureus; identical to SEQ ID NO: 35782
  subsp. aureus 68-397

SEQ ID NO: 35899 - protein, 648 aa, Staphylococcus aureus; identical to SEQ ID NO: 31909
  subsp. aureus 68-397

SEQ ID NO: 35900 - protein, 354 aa, Staphylococcus aureus; identical to SEQ ID NO: 30412
  subsp. aureus 68-397

SEQ ID NO: 35901 - protein, 105 aa, Staphylococcus aureus; identical to SEQ ID NO: 31168
  subsp. aureus 68-397

SEQ ID NO: 35902 - protein, 165 aa, Staphylococcus aureus; identical to SEQ ID NO: 31241
  subsp. aureus 68-397

SEQ ID NO: 35903 - protein, 319 aa, Staphylococcus aureus; identical to SEQ ID NO: 33985
  subsp. aureus 68-397

SEQ ID NO: 35904 - protein, 238 aa, Staphylococcus aureus; identical to SEQ ID NO: 31240
  subsp. aureus 68-397

SEQ ID NO: 35905 - protein, 241 aa, Staphylococcus aureus; identical to SEQ ID NO: 31239
  subsp. aureus 68-397

SEQ ID NO: 35906 - protein, 241 aa, Staphylococcus aureus; identical to SEQ ID NO: 31173
  subsp. aureus 68-397

SEQ ID NO: 35907 - protein, 192 aa, Staphylococcus aureus
  subsp. aureus 68-397
MYYVIIFIYYCKECFIMNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDMKISNTPKNSNQGNNLVVNNNEPTKEIKIANLEAQNSNQKKVNKGTNNYFGYYSFREAPKTQIYTVKKVTHLVL

SEQ ID NO: 35908 - protein, 328 aa, Staphylococcus aureus; identical to SEQ ID NO: 35727
  subsp. aureus 68-397

SEQ ID NO: 35909 - protein, 315 aa, Staphylococcus aureus; identical to SEQ ID NO: 35728
  subsp. aureus 68-397

SEQ ID NO: 35910 - protein, 151 aa, Staphylococcus aureus; identical to SEQ ID NO: 35733
  subsp. aureus 68-397

SEQ ID NO: 35911 - protein, 291 aa, Staphylococcus aureus; identical to SEQ ID NO: 30390
  subsp. aureus 68-397

SEQ ID NO: 35912 - protein, 890 aa, Staphylococcus aureus; identical to SEQ ID NO: 35735
  subsp. aureus 68-397

SEQ ID NO: 35913 - protein, 770 aa, Staphylococcus aureus
  subsp. aureus 68-397
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVNQMLNKLYVIKQRNKEKLSITRQMLLKMKFKMH

SEQ ID NO: 35914 - protein, 331 aa, Staphylococcus aureus; identical to SEQ ID NO: 31235
  subsp. aureus 68-397

SEQ ID NO: 35915 - protein, 808 aa, Staphylococcus aureus
  subsp. aureus 68-397
MSMTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAEAMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVVLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVTNSNDAGVNFELTK

SEQ ID NO: 35916 - protein, 258 aa, Staphylococcus aureus; identical to SEQ ID NO: 30518
  subsp. aureus 68-397

SEQ ID NO: 35917 - protein, 251 aa, Staphylococcus aureus; identical to SEQ ID NO: 30505
  subsp. aureus 68-397

SEQ ID NO: 35918 - protein, 261 aa, Staphylococcus aureus; identical to SEQ ID NO: 30506
  subsp. aureus 68-397

SEQ ID NO: 35919 - protein, 242 aa, Staphylococcus aureus; identical to SEQ ID NO: 30522
  subsp. aureus 68-397

SEQ ID NO: 35920 - protein, 239 aa, Staphylococcus aureus; identical to SEQ ID NO: 35743
  subsp. aureus 68-397

SEQ ID NO: 35921 - protein, 254 aa, Staphylococcus aureus; identical to SEQ ID NO: 31226
  subsp. aureus 68-397

SEQ ID NO: 35922 - protein, 689 aa, Staphylococcus aureus; identical to SEQ ID NO: 31861
  subsp. aureus 68-397

SEQ ID NO: 35923 - protein, 274 aa, Staphylococcus aureus; identical to SEQ ID NO: 33993
  subsp. aureus 68-397

SEQ ID NO: 35924 - protein, 339 aa, Staphylococcus aureus; identical to SEQ ID NO: 31219
  subsp. aureus 68-397

SEQ ID NO: 35925 - protein, 351 aa, Staphylococcus aureus; identical to SEQ ID NO: 33991
  subsp. aureus 68-397

SEQ ID NO: 35926 - protein, 231 aa, Staphylococcus aureus; identical to SEQ ID NO: 31216
  subsp. aureus 68-397

SEQ ID NO: 35927 - protein, 40 aa, Staphylococcus aureus; identical to SEQ ID NO: 31854
  subsp. aureus 68-397

SEQ ID NO: 35928 - protein, 512 aa, Staphylococcus aureus
  subsp. aureus 71193
MQYIIRYIMMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNKKPGKEDGNKPGKEDNKKPGKEDGNKPGKEDNKKPGKEDGNKPGKEDGNGIHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 35929 - protein, 241 aa, Staphylococcus aureus; identical to SEQ ID NO: 31149
  subsp. aureus 71193

SEQ ID NO: 35930 - protein, 691 aa, Staphylococcus aureus
  subsp. aureus 71193
MLRGQEERKYSIRKYSIGVVSVLAATMFIVSSHEAQASEKTPTSNAAAQKETLNQPGEQGNAVTSHQMQSGKQLDDMHKENGKSGTVTEGKDTLQSSKHQSTQNSKTSRTQNDNQVKQDSERQGSKQSHPNNATNKTERQNDQVQNTHHAERNESQSTTSQSNDVDKSQPSVPAQKVIPNHDKAAPTSTTLPSNDKTAPKSTKAQDASTDKHPNQQDTHQPAHQIIDAKQDDNVHQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFSSNYDRAVELYYYIKGGRVDYGAAHAAKYGHERYGKTYKGIMPNWEPGKKVHLVGHSMGGQTIRLMEEFLRNGNKEEIAYHQAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNNEPATRRGIWQVKPILQGWDHVDFIGVDFLDFKRKGAELANFYTGIINDLLRVEATEGKGTQLKAS

SEQ ID NO: 35931 - protein, 93 aa, Staphylococcus aureus; identical to SEQ ID NO: 32126
  subsp. aureus 71193

SEQ ID NO: 35932 - protein, 231 aa, Staphylococcus aureus
  subsp. aureus 71193
MGLKIMKFKAIAKASLALGMLATGVITSNIQSVQAKTEVKQQSESELKHYYNKPVLERKNVTGYKYTEKGKDYIDVIVDNQYSQISLVGSDKDKFKDGDNSNIDVFILREGDSRQATNYSIGGVTKSNSVQYIDYINTPILEIKKGNEDVLKDLYYISKEDISLKELDYRLRERAIKQHGLYSNGLKQGQITITMKDGKSHTIDLSQKLEKERMGDSIDGTKIDRILVEIK

SEQ ID NO: 35933 - protein, 238 aa, Staphylococcus aureus
  subsp. aureus 71193
MEHTIMKMKSIAKVSLVLGILATGVNTVTEQPVHAENKHVQVSQNSKNLKAYYTQPSVEYKNVTGYISSIQPKPGTKFLNMIEGNTVNNLALVGKDKEHYHTGVHRNLDIFYVNEDKRFEGAKYSIGGITKASDKVVDQVAEARVIKEDHTGEYAYDFFPFKIDKEAMTLKEVDFKIRKHLIDHYGLYGEMSSGTVTVQMKYYGKYTIELDKKLQEDRMADIVKAIDIDRIEVKVKKA

SEQ ID NO: 35934 - protein, 348 aa, Staphylococcus aureus
  subsp. aureus 71193
MEHTTMKIRIIAKASLALGLVTTGASIVTTQSANAEVASALKAGQLAKISVSPSAITTTTQAVNAEQNRTANTEQASKSNTENVSTSPSTKTEQTPKSNIQKATQQTPSVTTTPSPNVQPQSPQPTPKPTTPPSSNVETQQPQSPTTKQAQKEINPKFKGLRSYYTKPSLEFKNELGIIIKKWTTIRFMNIVPDYFIYKIALVGKDDKKYGEGVHRHVDVFIVLEQNKYGVDKYSVGGITKANRKKVDYNARIKITKEDKKGTISHDVSEYKITKEEISLKELDFKLRKQLIEQHNLYGNIGSGTIVIKMKNGGKYTFELHKKLQQHRMADVIDGTNIDRIEVNLKSS

SEQ ID NO: 35935 - protein, 322 aa, Staphylococcus aureus
  subsp. aureus 71193
MEHTTMRMTQIAKASLALGLLTTGASIVTTQSAKAEVTPSLKSEQLSMISVSPSAVTTTTQGVNAEVASALKTEQAIKSNIQKVTTSHSTNAQPQSTQSTPKPTTPPSANVETPQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSITKKDEEGKISRDVSEYKITKEEISLKELDFKLRKQLIEQHNLYGNIGSGTIVIKTKNGGKYTFELHKKLQEHRMADVIDGTSIDRIEVNLTSS

SEQ ID NO: 35936 - protein, 239 aa, Staphylococcus aureus
  subsp. aureus 71193
MEHTTMKMTAIAKASLALSILATGVITSTAQTVNASEHESKYENVTKDIFDLRDYYSRASKELKNVTGYRYSKGGKHYLIFDKHQKFTRIQIFGKDIEKLKARKNPGLDIFVVKEAENRNGTVYSYGGVTKKNKGAYYDYLSAPRFVIKKEVGAGVSVHVKRYYIYKEEISLKELDFKLRQYLIQDFDLYKKFPKASKIKVTMKDGGYYTFELNKKLQTNRMSDVIDGRNIEKIEANIR

SEQ ID NO: 35937 - protein, 231 aa, Staphylococcus aureus; identical to SEQ ID NO: 31157
  subsp. aureus 71193

SEQ ID NO: 35938 - protein, 232 aa, Staphylococcus aureus; identical to SEQ ID NO: 31158
  subsp. aureus 71193

SEQ ID NO: 35939 - protein, 227 aa, Staphylococcus aureus; identical to SEQ ID NO: 31159
  subsp. aureus 71193

SEQ ID NO: 35940 - protein, 226 aa, Staphylococcus aureus; identical to SEQ ID NO: 31160
  subsp. aureus 71193

SEQ ID NO: 35941 - protein, 972 aa, Staphylococcus aureus; identical to SEQ ID NO: 35306
  subsp. aureus 71193

SEQ ID NO: 35942 - protein, 1372 aa, Staphylococcus aureus
  subsp. aureus 71193
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVASEKNNNSQPSENGKLQTSDVKKTEANNTTLDDQVTTTVNSQQLNTDNTTSNATMSSAPINVSKDDLKINNEEVRNVGEKSDNADNANGSDVIMPKSTAPKRLNTRMRMAAIQSTSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSVYMDADTIPVDKKDVPFSVTIGNQTTTTTADITYPAYKEADNNSIGSAFTETVSHAGNAEDPGYYNQVVYVNPMDKDLKGANLKVEAYHPKYPANIGQINQNVTNIKIYRVPEGYTLNKGYDVNANDLVDVTDEFKNKMTYGTNQSVNIDFGDITSAYVVMVNTKFQYTNSESPTLVQMATLSSTGNKTVSTGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDEKGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHQNKAKALPETGSENNGSNNATLFGGLFAVLGSLLLFGRRKKQNK

SEQ ID NO: 35943 - protein, 1139 aa, Staphylococcus aureus
  subsp. aureus 71193
MINRDNKKAITKKGMISNRLNKFSIRKYTVGTASILVGTTLIFGLGNQEAKAAENTSTENAKQDEASTSDNKEVVSETENNSTTENTSTNPIKKETNTDSQPETKEESTTSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDRSTKPVATAPTSVAPKRLNAKMRFAVAQPAAVASNNVNDLIKVTKQTIKVGDGKDDVVAAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQNIEQQIYVNPLKKTATNTKVDIAGSQVDDYGNIKLGNGSTIIDQNTEIKVYKVNSNQQLPQSNRIYDFSQYEDVTSQFDNKKSFSNNVATLDFGNIDSAYIIKVVSKYTPTSDDELDIAQGASMRTTDKNNYYNYAGYSNFIVTSTDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKIIGTTTTDASGKYKFTDLDNGNYTVEFETPAGYTPTLKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTIDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTGKHIPVKPMSATKDHDNKAKALPETGSENNGSNNATLFGGLFAALGSLLLFGRRKKQNK

SEQ ID NO: 35944 - protein, 434 aa, Staphylococcus aureus [sequence omitted]

SEQ ID NO: 35945 - protein, 975 aa, Staphylococcus aureus
  subsp. aureus 71193
MNMKKQEKHAIRKKSIGVASVLVGTLIGFGLLSSKEADASENSMTQTENTRNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDTSTEVTPSNNESAPQSTDASNKDVVNQTVNTSASRMRAFSLAAADAPAVGTDITNQLTNVTVGIDSGTTVYPHQAGYVKLNYGFSVPNSAVQGDTFKITVPKELNLNGVTSTAKVPPIMAGDQVLANGVIDSDGNVIYTFTDYVDTKNDVKATLTVPAYIDPENVTKTGNVTLTTGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSASDSDSASDSDSTSDSDSTSDSDSTSDSDSTSDSDSASDSDSASDSDSTSDSDSTSDSDSVSDSDSASDSDSDSDSDSDSDSDSDSDSDSDSDSDSDSDSDSDSDSDSDSDSDSDSDSDSDSDSDSDSDSDSDSESDSDSDSDSESESDSDSDSDSDSDSDSDSDSDSDSDSDSDSDSDSDSDSDSDSDSASDSDSDSDSDSDSDSDSDSDSDNDSDSDSDSDSASDSDSGSDSDSSSDSDSDSASDSDSDSDSASDSDSGSDSDSSSDSDSDSASDSDSDSDSTSDTGSDNDSDSESDSNSDSESGSNNNVVPPNSPKNGTNASNKNEAKDSKEPLPDTGSEDEANTSLIWGLLASLGSLLLFRRKKENKDKK

SEQ ID NO: 35946 - protein, 642 aa, Staphylococcus aureus
  subsp. aureus 71193
MNKQQKEFKSFYSIRKSSLGVASLAISTLLLLMSNGEAKAAEETGGTNTEAQPKTEAVASPTTTTTEKAPEAKPVANAVSVANKEVVAPTTETKEVKEVKAPKEAKEEKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPATPSKPTTPPVEKESQKQDSQKDDNKQSASVEKENDASSESAKDKTPATKPAKAEVESSSTTPTKVVSTTQNVAKPTTASSETTKDVVQTSAGSSEAKDSAPLQKANIKNTNDGDTQSQNNKNTQENKAKSLPQTGEESNKDMTLPLMALLALSSIVAFVLPRKRKN

SEQ ID NO: 35947 - protein, 354 aa, Staphylococcus aureus; identical to SEQ ID NO: 31167
  subsp. aureus 71193

SEQ ID NO: 35948 - protein, 109 aa, Staphylococcus aureus
  subsp. aureus 71193
MLLIMKKNFIGKSILSIAAISLTVSTFAGESHAQTKAEKYNEYQTNFKKQVNKKVVDAQKAVNLFKRTRTVATHRKAQRAVNLIHFQHSYEKKKLQRQIDLVLKYNTLK

SEQ ID NO: 35949 - protein, 165 aa, Staphylococcus aureus; identical to SEQ ID NO: 31169
  subsp. aureus 71193

SEQ ID NO: 35950 - protein, 333 aa, Staphylococcus aureus
  subsp. aureus 71193
MFPQIVLKNRRMMKMKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKVQLQLSDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWTDRSSERYKIDWEKEEMTN

SEQ ID NO: 35951 - protein, 253 aa, Staphylococcus aureus
  subsp. aureus 71193
MLILVLMIMQKGEVRMRKRIMKKLIFMTTLLLLGTTATQTPNSPLNVSTDAKAYHIGQDETNINELIKYYTQPPLTFSNRWLYQYDDGNIYVEFKRYSWSAHIRLWGAESWGNVNQLRDRYVDVFGLKDEDTSQLWWVYRDTFTGGVTPAASPSDKPYSLFVQYKDKLQTIIGAHKMYQGNKPILTLKEIDFRARETLIKNKILYHENRNKGKLKIIGGGNDFTIDLSKRLHSDLANVYVKNPQKITVEVLID

SEQ ID NO: 35952 - protein, 273 aa, Staphylococcus aureus
  subsp. aureus 71193
MNTNRLNDLIDFSLFINLLFLAYNIPRKGDFLMKNNLTKKIILSIALTMIGTATSQSPHSPISMSSEAKAYNISESETNVNELTKYYTQRHLTFSNKWLWQKDNGTIHATLLQLSWFSHIQVFGPESWGNINQLRNKYVDIFALKDYETWRTYMLAQETFTGGVTPAAKPSDKYYKLNVTYKDKAGTFIGEYQFYTGNKPVLTLKEVDFRIRQTLIKNKKLYNGDYNKGHIKITGGSNNYPIDLSKRLKSTDANRYVKNPQTAHIEILLEKPS

SEQ ID NO: 35953 - protein, 251 aa, Staphylococcus aureus
  subsp. aureus 71193
MGNSRKGDYHMKKNITNKIVLSTALLLLGTTSTQPPKAPISFSSEAKAYNISENETNINELIKYYTQPHLSFSGKWLWQNPNGTIHATLQTWVWYTHIQVFGPESWGNINQLRDKYVDIFGTKDEDTIEGYWTYDETFTGGVTPAATSSDKPYKLFLKYKDKQQTMIGGLEFYQGNKPVITLKELDFRVRQTLIKNKKLYNGEFNKGQIRITGGGNHYTIDLSKKLKLTDTNRYVKNPRHAEIEVILEKSH

SEQ ID NO: 35954 - protein, 70 aa, Staphylococcus aureus; identical to SEQ ID NO: 31174
  subsp. aureus 71193

SEQ ID NO: 35955 - protein, 279 aa, Staphylococcus aureus
  subsp. aureus 71193
MWAHEPLHNKPYVVLYHLYLALKCKLIIVLGEFEVKYLTGFILILLLEGIFTNSASAIEYSDLHHKSKLDSKRLYNAKVSFANPTDLENKKTNDRLLKHDLLFHDMFVNDDWKKDFKVEFENEALSKKFINKDIDIFAGNYGYGCHGGEANKTQCSYGGVTFSDNNKYDDYKNIPCNLWIDGHQTEIELTAVKTKKKIVTIQELDVQLRNYLNEKYKLYEQGGDIVKGYVKYHNDDEKNVEYDFYNLNGEYGHEVLKMYADNKTINSDKLHLDIYLFKS

SEQ ID NO: 35956 - protein, 291 aa, Staphylococcus aureus; identical to SEQ ID NO: 30390
  subsp. aureus 71193

SEQ ID NO: 35957 - protein, 895 aa, Staphylococcus aureus; identical to SEQ ID NO: 31177
  subsp. aureus 71193

SEQ ID NO: 35958 - protein, 2182 aa, Staphylococcus aureus
  subsp. aureus 71193
MNLLKKNKYSIRKYKVGIFSTLIGTVLLLSNPNGAQALTTDHNVQGGSNQALPGNSPNTNADTNHDIVNGSQNTPNAHATDNTSTNQALTNHQNVGVANQVAPAPIQPSTSSASNNNHSDANSTATEPAANTNNNLASNNNTLNVPNNTDNNDSARHLTLKEIQEDVRHSSDKPELVAIAEEASNRPKKRSRRAAPADPNATPADPTAGNGSAPVAITAPFTPTTDPNANNIGQNAPNEVLTFDDNNIRPSTNRSVPTVTVVDNLPGYTLINGGKVGVFSHAMVRTSMFDSGDAKNYQAQGNVIALGRIKGNDTNDHGGFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDILTYKTYTQDFINSPAESHTVSTNPYTIDIIMNKDVLQAEVDRRIQQADYTFASLDIFNELKRRAQTILDENRNNVPLNKRVSQADIDSLVNQMQHTLIRSVDAENAVNRKVDDMEDLVNQNDELTDEEKQAAIQVIEEHKNEIIGNIGDQTTDDGVTRIKDQGIQTLSGDTATPVVKTNAKQAIRDKAAKQREIINNTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAAANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALNDIGVTSTTAMVNSIRDDAVNQIGAVQPHVTKKQTATGVLTDLATAKKQEINQNTNATDEEKQVALNQVDQDLATAINNINQADTNAEVDQAQQLGTKAINAIQPNIVKKPTALAQINQHYNAKLAEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAKVVIKPKAIADIEKAVKEKQQQIDNSLDSTDNEKEVALLALAKEKEKALAAIDQAQTNSQVNQAATNGVSAIKIIQPETKVKPAAREKINQKANELRAQINQDKEATAEERQAALDKINDLVAKAMTNITNDRTNQQVNDSTNQALDDIALVTPDHIVRATARDAVKQQYEAKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIASAVTNADVAYLLHDGKNEIREIEPVINKKATAREQLTTLFNDKKLAIEANVQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGIRMIDEDATLNDIKQHTQFIVDEILAIKLPAEATKVLPKVGQPAPKLCTSIKKVDKQEVRKVVKELPNTGSEEMDLPLKELALITGAALLARRRNKNEKES

SEQ ID NO: 35959 - protein, 350 aa, Staphylococcus aureus
  subsp. aureus 71193
MYLALCTNHIVNNEGDFLGMSNQFKSEEERRQWEQFQAFQNQQNQQHQQYGQKKSKKGWFWGCGGCLVLFILIIIGISACTAGVTGNLGGNSSKETNKTHKIGETVKNGDLEVTVNSVETMKSVGPSLAPTNAKGIFVVADVTIKNKGKEALTIDSSMFKLKSGDKTFEADNTGSMSANQNDNGSIENSFFLQRINPDSTAQGKIVFDVSENIANAKDKKLEVISSLFSVKKITFDLSDAKKTSKAKKDKQDTEVAVASSNSDNVSYEASATTPATTSSADTDSEDSEKSSKDEDKQNASKSDKSSVEKSESNEETAPVEPMRQSKPTTSEAPPSQNIHNEDSMYDASTE

SEQ ID NO: 35960 - protein, 844 aa, Staphylococcus aureus
  subsp. aureus 71193
MVTDGFHASTNFPILWKVESLINHNINCIHAKKGDMSMTYKMKKWQKLSTITLLMAGVITLNNGEFRNVDKHQIAVADTNVQTPDYEKLKKTWLDVNYGYDQYDENNQDMKKKFDAKEKEAKKLLEDMKTDTNRTYLWDSAKDLDKKSADMTKTYRNIEKIAEAMRHKNTSLKTDENKLKITDAIKWLHHNVYGKDPDKKVTDLTTNRKEKDSSKKNNSLNWWDYEIGTPRALTNTLLLMDDMLTKDEMKNYSKPISTYAPSSDKILSSVGESEDAKGGNLVDISKVKLLESVIEEDETMMKNSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDDSTKAKYKQIVKTSVNSDSSYNQNDYLNSYSDIDKMKKLMDDSTISKNDLTQQLKIYNDMDRVTYHNKDLDFAFGLSMTSKNVARYESINNENLKGWHTGAGMSYLYNSDVKHYRDNFWATADMTCLPGTTTLNDMPSTNTKNDKSFVGGTKLNNKYASIGMDFENQDKTLTAKKSYFILNDKIVFIGTGIKSTDSSKNPVTSVENRKAVGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDNNTYECSFYNPTSTNSTSNKESKISVTGYTITNQSVSNFKESDIHFELTK

SEQ ID NO: 35961 - protein, 689 aa, Staphylococcus aureus; identical to SEQ ID NO: 31181
  subsp. aureus 71193

SEQ ID NO: 35962 - protein, 274 aa, Staphylococcus aureus; identical to SEQ ID NO: 30872
  subsp. aureus 71193

SEQ ID NO: 35963 - protein, 338 aa, Staphylococcus aureus; identical to SEQ ID NO: 31183
  subsp. aureus 71193

SEQ ID NO: 35964 - protein, 372 aa, Staphylococcus aureus
  subsp. aureus 71193
MILFTCRYLSTILNIRKKVITMKNKKRVFIASSLSCALLLLSAANTEANSANKDSQDQTKKEHVDKAQQKEKRNVNDKDKNTPGPDDIGKNGKVTKRTETVYDEKTNILQNLQFDFIDDPTYDKNVLLVKKQGSIHSNLKFESHKEENNSSWLKYPSEYHVDFQVKSNRKTEILDQLPKNKISTAKVDSTFSYNSGGKFDSVKGVGRTSSNSYSKTISYNQQNYDTIASGKNNNWHVHWSVVANDLKYGGEVKNRNDDFLFYRNTRLSTVENPELSFASKYRYPALVRSGFNPEFLTYLSNEKSNEKTQFEVTYTRNQDVLKNKPGIHYAPPILEKNKDGQRLIVTYEVDWKNKTVKVIDKYSDENKPYKEG

SEQ ID NO: 35965 - protein, 45 aa, Staphylococcus aureus; identical to SEQ ID NO: 31097
  subsp. aureus 71193

SEQ ID NO: 35966 - protein, 231 aa, Staphylococcus aureus; identical to SEQ ID NO: 30654
  subsp. aureus 71193

SEQ ID NO: 35967 - protein, 2459 aa, Staphylococcus aureus; identical to SEQ ID NO: 32108
  subsp. aureus 71193

SEQ ID NO: 35968 - protein, 811 aa, Staphylococcus aureus
  subsp. aureus 71193
MSMTYRMKKWQKLSTITLLMAGVITLNGGEFRSVDKHQIAVADTNVQTPDYEKLRNTWLDVNYGYNKYDENNDAMKKKFEATEKEAEKLLSSMKTESGRTYLWAGAENLETNSSHMTRTYRNIEKIAEAMKHKNTKLKTDENKTKVKDALEWLHENAYGKEPDKKVADLKTNFSKSAPQKNTNLNWWDYEIGTPRALTNTLILLNGDISSDEKKKYTAPIKTFAPKSDEILSSVGKAEPAKGGNLVDISKVKLLESIIEEDTTMMKESIVAFNKVFTYVQSNATDKERNGFYKDGSYIDHKDVPYTGAYGVVLLEGISQMMPMIKETPFNDKTQNNTTLKSWIDDGFLPLIYKGEMMDLSRGRAISRENETSHTASATVMKSLLRLSDTMDDSTKTKYKQIIKTSVKSDSSYNQNDYLNSYSDIDKMKKLIDDKSITTNDLTQQLKIYNDMDRVTYHNKDLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNKPKITVTKETHTGNWKEINKSQKDTQKTDEYYEVTQKHSNSDNKYGYVLYPGLSKDVFKSKASQVTVVKQDDDFHVVKDNESVWAGVNYSDSTQNFEINGTKVEVKAKGMFILKKKDDNTYECSFYNPESTNSASDIESKISMTGYSITNKNTSTTNESGVRFELTK

SEQ ID NO: 35969 - protein, 141 aa, Staphylococcus aureus; identical to SEQ ID NO: 31189
  subsp. aureus 71193

SEQ ID NO: 35970 - protein, 321 aa, Staphylococcus aureus; identical to SEQ ID NO: 31190
  subsp. aureus 71193

SEQ ID NO: 35971 - protein, 318 aa, Staphylococcus aureus
  subsp. aureus 71193
MKLMLKNKILATTLSVSLLAPLANPLLENAKAANDTEDIGKGNDVEIIKRTEDKTSNKWGVTQNIQFDFVKDKKYNKDALILKMQGFISSRTTYYNYKNTNHIKSMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFKNRNYTVKYEVNWKTHEIKVKGQN

SEQ ID NO: 35972 - protein, 325 aa, Staphylococcus aureus; identical to SEQ ID NO: 30479
  subsp. aureus 71193

SEQ ID NO: 35973 - protein, 951 aa, Staphylococcus aureus
  subsp. aureus 71193
MKSNLRYGIRKHKLGAASVFLGTMIVVGMGQEKEAAASEQNNTTVEESGNSATESKASETQTTTNNVNTIDETQSYSATSTEQPSQSTQVTTEEAPTTVQAPKAETSRVDLPSEKAADKGIVGTQVDTTQPSNVSEIKPRMKRSADVTAASEKEVVEEAKVTGTDVTSKVKVEEGSEIVGHNNKETNVVNPHNAERVTLKYKWKFEDGIKPGDYFDFTLSNNVETHGISPLRKVPDIKSKDGQVMAVGEVNEERKIRYTFKEYVQGKKDLKAELDLNLFIDPTTVTKRGNQNIEVTLGEKKISKQFDIKYLDGVKDNWGVTVNGRIHTLNKQEGRFSHFAYVKPNNQSLTSVTVTGQVTSGYKQNAKNPTVKVYKHIGSDELAESVYGDVLDETKFEDVTDKLSLTLTGNGGYTLDFSELDKTKNYVIKYEGDYNSSASDLNFQTKLSGYHNYYYSYYPVQLTWNNGVAFYSNNAQGDGKDKPKEPIIEHSTPIELEFKSEPPMEKHELTGTVEESDDSKPIDFEYHTAVEGAEGHAEGTIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPGEPTPPTPEVPSEPETPVPPTPEVPSEPGKPVPPAKEEPKKPSKPVEQGKVVTPVIEINEKVKAVAPTKQKQSKKSELPETGGEESTNKGILFGGLFSILGLALLRRNKKNHKA

SEQ ID NO: 35974 - protein, 1025 aa, Staphylococcus aureus
  subsp. aureus 71193
MHLKGDIIVKNNLRYGIRKHKLGAASVFLGTMIVVGMGQDKEAAASEQKTTTVEENGNSATENKTSETQTTATNVNHIEETQSYNATVTEQPSNATQVTTEEAPKAVQAPQTAQPANVETVKEEVVKEEAKPQVKETTQSQDNSGDQRQVDLTPKKATQNQAAETQVEVAQPRTVSESKPRVTRSADVVEAKEASDASEIKGTDVTSKVTVTESSIEGHNNTNKVEPHAGQRAVLKYKLKFEDGLKKGDYFDFTLSNNVNTYGVSTARKLPEIKNGSVVMATGQLLGDGKIRYTFTDYIDYKVNVIANLNLNLFIDPRIVKNNGEETLTSKLNGKNTEKKIEVEYKDGVGKYYTNLNGSIETFNKADNKFTHVAYVKPINGNKSESVSITGSLTQGSNVSGDSPIVKVYEYQGKETDLPKSVSVNLTDNSKFKDVTSDMQNKLTVQENGNYQLNLEKLDKTYVIHYTGEYSKETDEVNFRTQVSAYPENSYRYYSYYNNHYTLTWDNGLVLYSNKADGNGQNGVKVESNNLIFDEVTGTGVITGQYDKNLVTTVEEETDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPETPTPPTPEVPSEPGEPTPPTPEVPAEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 35975 - protein, 233 aa, Staphylococcus aureus; identical to SEQ ID NO: 31195
  subsp. aureus 71193

SEQ ID NO: 35976 - protein, 951 aa, Staphylococcus aureus
  subsp. aureus 71193
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTKDANSIATNSELKNPQTLDLPQSSPQTISNAQGTSKPSVRTRAVRSLTVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFNNRIFYEHPNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPEPEPTPDPEPSPEPEPEPTPDPEPSPEPEPEPTPDPEPSPEPEPEPTPDPEPSPDPDPDSDSDSDSGSDSDSDSDSDSDSDSDSDSDSDSESDSDSDSESDSESDSDSDSDSDSDSDSDSDSDSDSNSDSESDSDSDSDSDSDSDSDSDSDSDSDSDSDSDSDSDSGSDSDSDSDSDSDSDSDSDLDSDSDSESDSDSDSDSDSDSDSESDSDSDLDSDSDSDSDSDSDSDSDSDSDSDSDSDSESDSDSDSDSDSDSDSDSESDSDSDSDSDSDSDSDSDSDSDSDSDSDSDSRVTPPNNEQKAPSNPKGEVNHSNKASKQHQTDALPETGDKSENTNATLFGAMMALLGSLLLFRKRKQDHKEKA

SEQ ID NO: 35977 - protein, 2279 aa, Staphylococcus aureus; identical to SEQ ID NO: 31197
  subsp. aureus 71193

SEQ ID NO: 35978 - protein, 684 aa, Staphylococcus aureus
  subsp. aureus 71193
MLTMMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDSNANNNLPSQSRTKVAPSLNKSDQTSQREIVNETEIEKVQPQQKNQSNDKMTSHHFNNEQEVNPQKDEKTLSVSDLKNNQKSPVEPTKNNDKKKGLNLLKSSAVATLPNKGTKELTAKATGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 35979 - protein, 996 aa, Staphylococcus aureus
  subsp. aureus 71193
  MOD_RES (533)..(679): Any amino acid
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKSYVSKDITIKDQIQGGQQLDLSTLNINVTGTHSDYYSGPNAITDFEKAFPGSKITVDNTKNTIDVTIPQGYGSLNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIKTDANGIANIKALPSGDYILKEIEAPAPYIFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDATPEGYTKKENGLVVTNTEKPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKAKNQQVKYTVEELTKVKGYTTHVDNNDIGNLIVTNKYTPETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 35980 - protein, 51 aa, Staphylococcus aureus
  subsp. aureus A017934/97
MSATKDHHNKAKALPETGSENNGSNNATLFGGLFAALGSLLLFGRRKKQNK

SEQ ID NO: 35981 - protein, 54 aa, Staphylococcus aureus; identical to SEQ ID NO: 35777
  subsp. aureus A017934/97

SEQ ID NO: 35982 - protein, 933 aa, Staphylococcus aureus
  subsp. aureus A017934/97
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEE

SEQ ID NO: 35983 - protein, 434 aa, Staphylococcus aureus [sequence omitted]

SEQ ID NO: 35984 - protein, 62 aa, Staphylococcus aureus; identical to SEQ ID NO: 35782
  subsp. aureus A017934/97

SEQ ID NO: 35985 - protein, 652 aa, Staphylococcus aureus; identical to SEQ ID NO: 34746
  subsp. aureus A017934/97

SEQ ID NO: 35986 - protein, 354 aa, Staphylococcus aureus; identical to SEQ ID NO: 30412
  subsp. aureus A017934/97

SEQ ID NO: 35987 - protein, 105 aa, Staphylococcus aureus; identical to SEQ ID NO: 31168
  subsp. aureus A017934/97

SEQ ID NO: 35988 - protein, 165 aa, Staphylococcus aureus; identical to SEQ ID NO: 31241
  subsp. aureus A017934/97

SEQ ID NO: 35989 - protein, 238 aa, Staphylococcus aureus; identical to SEQ ID NO: 31240
  subsp. aureus A017934/97

SEQ ID NO: 35990 - protein, 241 aa, Staphylococcus aureus
  subsp. aureus A017934/97
MKNNLTKKIILSIALTMIGTATSQSPHSPISMSSEAKAYNISESETNVNELTKYYTQRHLTFSNKWLWQKDNGTIHATLLQLSWFSHIQVFGPESWGNINQLRNKYVDIFALKDYETWRTYMLAQETFTGGVTPVAKPSDKHYKLNVTYKDKAGTFISEYQFYTGNKPVLTLKEVDFRIRQTLIKNKKLYNGDYNKGHIKITGGSNNYTIDLSKRLKSTDANRYVKNPQTAHIEILLEKSS

SEQ ID NO: 35991 - protein, 241 aa, Staphylococcus aureus; identical to SEQ ID NO: 31173
  subsp. aureus A017934/97

SEQ ID NO: 35992 - protein, 372 aa, Staphylococcus aureus; identical to SEQ ID NO: 33950
  subsp. aureus A017934/97

SEQ ID NO: 35993 - protein, 2985 aa, Staphylococcus aureus
  subsp. aureus A017934/97
MNYRDKIQKFSIRKYTVGTFSTVIATLVFLGLNTSQAQAAETNQPASALKQKQQNGDTQTENREVEVQNSQNGQSLSAPIENEQPNNNQTNHVDASAVQSSTTEHDQPVSQNEQAKKDTAAATPTQSAKAASKHEQSESRAANKKENDNKATHVESHEANVVTASDSSDSGNVQHDRNELQAFFDANYHDYRFIDRENADSGTFNYVKGIFDKINTLLGSNDPINNKDLQLAYKELEQAVALIRTMPQRQQTSRRSSRIQTRSIESRAAEPRSVSDYQNANSSYYVENANDGSGYPVGTYINASSKGAPYNLPTTPWNTLKASDAKEIALITAKQTGDGYQWVIKFNKGHAPHENMIYWFALPAGQTPVGRTEFVTVNADGTNVQWSNGAGAGANKPLPEMWPYGVNDSRSWDYKIRNRSGQVIYDWPTVHINSLKDLAHASDYFSEAGATPATKAFGRQTFEYINGERPTESPGVPKVYTFIGKGDASYTISFKTQGPTIDKLYYAAGGRALEYNQLFMYSQLYVESTQDYQQRLNGLRQVVNRTYRIGTTKRVEVSQGNVQTKKVLESTNLNIDDFMDDPLSYVKTPSNKVLGFYPTSANTNAFRPGGVNPLNEYQLSQLFTDDKLQQAARTGSPIRLMIGFDYPDAFGNGETLVPVNLTVLPEIQHNIKFFKNDDGQNIADKPASKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPRITTTAEELRGTALQKVPVTVTDIPLDPSALVYLVIPTSQTRDGGSEADQIPSGYTKIATGTPDGVHSTITIRPEDYVVFIPPVGNQIRALIFYNNVVASNMSNAVTILPDDIPPTINNPVGLNAKYYRGDEVSFTMGVSDRHSGLKSTTITTLPSGWTSNLTKSDKKNGSLAISGRVSMNQAYNSDITFKVSATDNVNNTTNDSQSKHVTVHVGKISDDAHPIVLGNSEKVVVVNPTALTGDEKQRITTAFMNKNQNIRGYLASSNPVTVDNHGNVTLQYRDGSSTTLDATNVMTYEPVVKPEYQTANAAKTATVTIAKGQSFNIGDIKQYFTLSNGQAIPSSSFTNITSDRTIPTAQEVSQMNAGTQLYHIVATNAYHKDTEDFYITLKIIDVKQPEGDQRVYRMSTYDITTDEISKVKQAFINANRDAISFAEGDISVTNTPNGSNVSTITVNINKGRLTKSFTSNLNNMNFLRWVNFPQDYTVTWTNAKIANRPTDGGLSWSDDHKSLIYRYDATLGTQITTNDILTLLKATTTVPGLRNNIAGNEKAQAEAGGRPNYKTTGYSQSNPTSDGQRQFTLNGQVIQIMDIINPSNGFGGQPVTNSNVRANHSNSTVVSVNESAANGAGAFTIDHVVKNNSTHNAADAVYKAQLYLSPYGPKQYVEHLNQNTDNTNEAINIYFVPSDLVNPTISVGNYTNHQVFSGETFTNTITANDNFGVQSVTVPTTSQLTGTVDNNHQHVSATAPNVTSTTNKTINLVATDTSGNTATTSFNVTIKPLRDKYRVGTSSTAANPVRIANISNNATVSQADQTAIINSLTFTSNAPNRNYATASANEITSKTVSNVSRTGNNAQVTVTVTYQDGTTSTVTVPVKRVIPEIVAHSHYTVQGQDFPTGNGASASDYFKLSNGSAIPDATITWVSGQAPNKNNTTIGQDINVTAHILIDGETTPITKTATYKVVRTVPKQVFETARGVLYPGVSDMYDAKQYVKPVNNSWSTNAQHMNFQFTNSYGPSKDVVGISTRDIRVTYDNHQTQIIKILSKVKPDPPRIDGNSVTYKAGLTNQQIKINNVLSSSSIKLFKADNTPLTITNTTYGSGNTAVVTVSDALPNGEIKARSSISMNNVTYTTQDEHGRAIDVTRNESVDSNDSASVHVTPQLQATTEGAVFIKGGDGFDFGHVERFIQNPPHGATVAWHDNPDTWKNTVGNTHKTAVVTLPNGQGTRNVEVPVKVYPVANAKAPSRDVKGQNLTNGTDAINYITFDPNTNTNGITAVWANRQQPNNQQAGVQHLNVDVTYPGISAAKRVPVTVNVYQFEFPQTSYTTTVGGTLASGTQASGYAHIQNATGLPTDGFTYKWNNAATGTNDANWAAMNKPNTAQVINAKYDVIYNGHTFATSLPAKFVVKDVQPAKPTVTETAAGVITIAPGANQTVNTHAGNVTTYADKLVIKRNGNVVTTFTRHNNTSPWVKEASAANVAGIAGTNNGITVAAGTFNPADTIQAVATQGSGETISDEQRSDDFTVVAPQPNQATTKIWQNGHVDITPNNPSGHLINPTQAMDIAYTEKVGNGAEHSKTLNAVRGQNNQWTIANKPDYVTLDAHTGKVTFNANTIKPNSAITITPKAGTGHSASSNPSTLTAPAAHTVNTTEIVKDYGSNVTAAEINNAVQVANKRTATIKNGTAMPTNLAGGSTTTIPVTVTYNDSSTEEVQESIFTKADKRELITAKNHLDDPVSTDGKKPGTITQYNNAIHNAQQQINTAKTEAQQVINDERATPQQVNAALSKVQAAQTKINEAKALLQNKEDNSQLVTSKNNLQSSVNQVPSTTGMTQQSIDNYNAKKREAESEITAAQRVIDNGDATAQQISDEKHRVDNALTALNQAKQNLTADTHELEQAVHQLNRTGTTTGKKPASITAYNNSIRALQSDLTSAKNSANAIIQKPIRSVQEVQTALTNVNRVNDRLTLAINQLVPLADNSALRTAKTKLDEEINKSVTTDGMTQSSIQAYENAKRAGQTESTNAQNVINNGDATDQQIAAKKTKVEEKYNGLKQAIAGLTPDLAPLQAAKTQLQNDIDQPTSTTGMTSASVAAFNDKLSAARTKIQEIDRVLASHPDVATIRQNVTAANATKTALDQARNGLTVDKAPLENAKNQLQQSIDTQTSTTGMTQDSINAYNAKLTAARNKIQQINQV

SEQ ID NO: 35994 - protein, 422 aa, Staphylococcus aureus
  subsp. aureus A017934/97
MKTIEEIKSTPKTVMKKPELLAPAGNLEKLKIAVHYGADAVFLGGQEYGLRSNADNFTMEEIAEGVEFANRYGAKIYVTTNIIAHDENIEGLESYLRNLEKTGATGIIVADPLIIETCKEVAPKLEIHLSTQQSLSNYKAVEYWKEEGLDRVVLARETGAMEMREMKEKVDIEIEAFIHGAMCIAYSGRCTLSNHMTARDSNRGGCCQSCRWDYELLEVDDNGELDVFYNQGEVTPFAMSPKDLKLIESIPQMMDIGVDSLKIEGRMKSIHYIATVVSVYRKVIDAYAADPDNFKINPEWLIELDKCANRDTAPAFFEGTPGYEEQMFGQQQSKKSPFDFCGLVLDYNEDTKIATIQQRNNFKPGQEIEFFGPEIETFTQVVEAIYDEEGNSLDAARHPLQIVQIKVDRPIYPNNMMRKEIG

SEQ ID NO: 35995 - protein, 291 aa, Staphylococcus aureus; identical to SEQ ID NO: 30390
  subsp. aureus A017934/97

SEQ ID NO: 35996 - protein, 331 aa, Staphylococcus aureus; identical to SEQ ID NO: 31235
  subsp. aureus A017934/97

SEQ ID NO: 35997 - protein, 808 aa, Staphylococcus aureus
  subsp. aureus A017934/97
MSMTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 35998 - protein, 258 aa, Staphylococcus aureus; identical to SEQ ID NO: 30518
  subsp. aureus A017934/97

SEQ ID NO: 35999 - protein, 251 aa, Staphylococcus aureus; identical to SEQ ID NO: 30505
  subsp. aureus A017934/97

SEQ ID NO: 36000 - protein, 261 aa, Staphylococcus aureus; identical to SEQ ID NO: 30506
  subsp. aureus A017934/97

SEQ ID NO: 36001 - protein, 242 aa, Staphylococcus aureus; identical to SEQ ID NO: 30522
  subsp. aureus A017934/97

SEQ ID NO: 36002 - protein, 239 aa, Staphylococcus aureus; identical to SEQ ID NO: 30171
  subsp. aureus A017934/97

SEQ ID NO: 36003 - protein, 254 aa, Staphylococcus aureus; identical to SEQ ID NO: 31226
  subsp. aureus A017934/97

SEQ ID NO: 36004 - protein, 274 aa, Staphylococcus aureus; identical to SEQ ID NO: 35568
  subsp. aureus A017934/97

SEQ ID NO: 36005 - protein, 339 aa, Staphylococcus aureus; identical to SEQ ID NO: 31219
  subsp. aureus A017934/97

SEQ ID NO: 36006 - protein, 351 aa, Staphylococcus aureus; identical to SEQ ID NO: 31218
  subsp. aureus A017934/97

SEQ ID NO: 36007 - protein, 234 aa, Staphylococcus aureus; identical to SEQ ID NO: 30530
  subsp. aureus A017934/97

SEQ ID NO: 36008 - protein, 231 aa, Staphylococcus aureus; identical to SEQ ID NO: 31216
  subsp. aureus A017934/97

SEQ ID NO: 36009 - protein, 808 aa, Staphylococcus aureus; identical to SEQ ID NO: 31215
  subsp. aureus A017934/97

SEQ ID NO: 36010 - protein, 141 aa, Staphylococcus aureus; identical to SEQ ID NO: 31214
  subsp. aureus A017934/97

SEQ ID NO: 36011 - protein, 321 aa, Staphylococcus aureus
  subsp. aureus A017934/97
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKRGVKANSFVTPNGQVSAYDQYLFAQDPTGPAARDYFVPDNQLPPLIQSGFNPSFITTLSHEKGKGDKSEFEITYGRNMDATYAYVTRHRLAVDRKHDAFKNRNVTVKYEVNWKTHEVKIKSITPK

SEQ ID NO: 36012 - protein, 315 aa, Staphylococcus aureus; identical to SEQ ID NO: 31191
  subsp. aureus A017934/97

SEQ ID NO: 36013 - protein, 325 aa, Staphylococcus aureus; identical to SEQ ID NO: 30479
  subsp. aureus A017934/97

SEQ ID NO: 36014 - protein, 942 aa, Staphylococcus aureus; identical to SEQ ID NO: 35550
  subsp. aureus A017934/97

SEQ ID NO: 36015 - protein, 233 aa, Staphylococcus aureus; identical to SEQ ID NO: 31039
  subsp. aureus A017934/97

SEQ ID NO: 36016 - protein, 780 aa, Staphylococcus aureus
  subsp. aureus A017934/97
MSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSDSDSDSDSDSDSDSDSDSDSESDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 36017 - protein, 91 aa, Staphylococcus aureus; identical to SEQ ID NO: 35761
  subsp. aureus A017934/97

SEQ ID NO: 36018 - protein, 681 aa, Staphylococcus aureus
  subsp. aureus A017934/97
MMKSQNKYSIRKFSVGASSILIATLLFLSGGQAQAAEKQVNMGNSQEDTVTAQSIGDQQTRENANYQRENGVDEQQHTENLTKNLHNDKTISEENYRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHSGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 36019 - protein, 512 aa, Staphylococcus aureus
  subsp. aureus A017934/97
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 36020 - protein, 221 aa, Staphylococcus aureus; identical to SEQ ID NO: 31036
  subsp. aureus A017934/97

SEQ ID NO: 36021 - protein, 691 aa, Staphylococcus aureus; identical to SEQ ID NO: 31040
  subsp. aureus A017934/97

SEQ ID NO: 36022 - protein, 226 aa, Staphylococcus aureus; identical to SEQ ID NO: 31265
  subsp. aureus A017934/97

SEQ ID NO: 36023 - protein, 231 aa, Staphylococcus aureus; identical to SEQ ID NO: 35706
  subsp. aureus A017934/97

SEQ ID NO: 36024 - protein, 343 aa, Staphylococcus aureus; identical to SEQ ID NO: 31263
  subsp. aureus A017934/97

SEQ ID NO: 36025 - protein, 325 aa, Staphylococcus aureus; identical to SEQ ID NO: 33964
  subsp. aureus A017934/97

SEQ ID NO: 36026 - protein, 234 aa, Staphylococcus aureus; identical to SEQ ID NO: 30567
  subsp. aureus A017934/97

SEQ ID NO: 36027 - protein, 231 aa, Staphylococcus aureus; identical to SEQ ID NO: 30566
  subsp. aureus A017934/97

SEQ ID NO: 36028 - protein, 232 aa, Staphylococcus aureus; identical to SEQ ID NO: 30565
  subsp. aureus A017934/97

SEQ ID NO: 36029 - protein, 227 aa, Staphylococcus aureus; identical to SEQ ID NO: 30564
  subsp. aureus A017934/97

SEQ ID NO: 36030 - protein, 232 aa, Staphylococcus aureus; identical to SEQ ID NO: 31257
  subsp. aureus A017934/97

SEQ ID NO: 36031 - protein, 314 aa, Staphylococcus aureus
  subsp. aureus ATCC 51811
MKLMFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 36032 - protein, 327 aa, Staphylococcus aureus; identical to SEQ ID NO: 30538
  subsp. aureus ATCC 51811

SEQ ID NO: 36033 - protein, 331 aa, Staphylococcus aureus; identical to SEQ ID NO: 31305
  subsp. aureus ATCC 51811

SEQ ID NO: 36034 - protein, 1329 aa, Staphylococcus aureus
  subsp. aureus ATCC 51811
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVASNNTTLNVPNKTNENGSGGHLTLKEIQEDVRHSSDKPELVAIAEPASNRPKKRSRRAAPADPNATPADPGAAAAGNGGAPVAITAPYTPTTDPNANNAGQNAPNEVLSFDDNSIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNADTNDTIAEKTVEGGPTLRLFKVPDNVRNLKIQFVPKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGSVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNAEVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKNKQREIKSLLKWRSVLKRLNKHLMQLTKKSRLLLIKSINLKIKHLIKLIKTKQMIR

SEQ ID NO: 36035 - protein, 895 aa, Staphylococcus aureus
  subsp. aureus ATCC 51811
MNKHHPKLRSFYSIRKSILGVASVIVSTLFLITSQHQAQAAENTNTSDKISENQNNNATTTQPPKDTNQTQPATQPANTAKTYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTINNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPDSDVVKDADNNIDKDVQHDVDHLSDMSDNNHFDKYDLKEMDTQIAKDTDRNVDKGADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 36036 - protein, 291 aa, Staphylococcus aureus; identical to SEQ ID NO: 30390
  subsp. aureus ATCC 51811

SEQ ID NO: 36037 - protein, 234 aa, Staphylococcus aureus
  subsp. aureus ATCC 51811
MLEEILTNSASAIEYSDLHHKSKFDSKRLSNAKMSFINPTQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQAEIELTAVKTKKKIVTIQELDVQLRNYLNEKYKLYEQGGDIVKGYVKYHNDDEQNIEYNFYNLNGEYGYEVLKMYADNKTINSDKLHLDIYLFKS

SEQ ID NO: 36038 - protein, 372 aa, Staphylococcus aureus; identical to SEQ ID NO: 30609
  subsp. aureus ATCC 51811

SEQ ID NO: 36039 - protein, 241 aa, Staphylococcus aureus; identical to SEQ ID NO: 31311
  subsp. aureus ATCC 51811

SEQ ID NO: 36040 - protein, 241 aa, Staphylococcus aureus; identical to SEQ ID NO: 30739
  subsp. aureus ATCC 51811

SEQ ID NO: 36041 - protein, 271 aa, Staphylococcus aureus
  subsp. aureus ATCC 51811
MELIKIIANTILTSLTFKFLIPRIMIPLKGDVLMSKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKGRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 36042 - protein, 260 aa, Staphylococcus aureus
  subsp. aureus ATCC 51811
MHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWTDRSSERYKIDWEKEEMTN

SEQ ID NO: 36043 - protein, 165 aa, Staphylococcus aureus; identical to SEQ ID NO: 31315
  subsp. aureus ATCC 51811

SEQ ID NO: 36044 - protein, 105 aa, Staphylococcus aureus; identical to SEQ ID NO: 31317
  subsp. aureus ATCC 51811

SEQ ID NO: 36045 - protein, 350 aa, Staphylococcus aureus; identical to SEQ ID NO: 30602
  subsp. aureus ATCC 51811

SEQ ID NO: 36046 - protein, 645 aa, Staphylococcus aureus; identical to SEQ ID NO: 30747
  subsp. aureus ATCC 51811

SEQ ID NO: 36047 - protein, 946 aa, Staphylococcus aureus; identical to SEQ ID NO: 31583
  subsp. aureus ATCC 51811

SEQ ID NO: 36048 - protein, 434 aa, Staphylococcus aureus [sequence omitted]

SEQ ID NO: 36049 - protein, 1141 aa, Staphylococcus aureus; identical to SEQ ID NO: 31329
  subsp. aureus ATCC 51811

SEQ ID NO: 36050 - protein, 1371 aa, Staphylococcus aureus; identical to SEQ ID NO: 33293
  subsp. aureus ATCC 51811

SEQ ID NO: 36051 - protein, 961 aa, Staphylococcus aureus
  subsp. aureus ATCC 51811
MNNKKTVTNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVSLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTNQFNITYSNDNKTATVDLMNGQTSSNKQYIIQQVAYPDNTSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSESDADSDTDSDSDAGKHTPAKPMSTVKDQHKTAKALPETGSENNNSNNGTLFGGLFAALGSLLLFGRRKKQNK

SEQ ID NO: 36052 - protein, 148 aa, Staphylococcus aureus
  subsp. aureus ATCC 51811
SDSDSDSESDSDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 36053 - protein, 96 aa, Staphylococcus aureus; identical to SEQ ID NO: 31559
  subsp. aureus ATCC 51811

SEQ ID NO: 36054 - protein, 331 aa, Staphylococcus aureus; identical to SEQ ID NO: 33420
  subsp. aureus ATCC 51811

SEQ ID NO: 36055 - protein, 338 aa, Staphylococcus aureus; identical to SEQ ID NO: 31292
  subsp. aureus ATCC 51811

SEQ ID NO: 36056 - protein, 350 aa, Staphylococcus aureus; identical to SEQ ID NO: 31291
  subsp. aureus ATCC 51811

SEQ ID NO: 36057 - protein, 230 aa, Staphylococcus aureus; identical to SEQ ID NO: 31333
  subsp. aureus ATCC 51811

SEQ ID NO: 36058 - protein, 227 aa, Staphylococcus aureus; identical to SEQ ID NO: 31334
  subsp. aureus ATCC 51811

SEQ ID NO: 36059 - protein, 232 aa, Staphylococcus aureus; identical to SEQ ID NO: 31335
  subsp. aureus ATCC 51811

SEQ ID NO: 36060 - protein, 234 aa, Staphylococcus aureus; identical to SEQ ID NO: 31336
  subsp. aureus ATCC 51811

SEQ ID NO: 36061 - protein, 231 aa, Staphylococcus aureus; identical to SEQ ID NO: 31337
  subsp. aureus ATCC 51811

SEQ ID NO: 36062 - protein, 232 aa, Staphylococcus aureus; identical to SEQ ID NO: 31338
  subsp. aureus ATCC 51811

SEQ ID NO: 36063 - protein, 239 aa, Staphylococcus aureus
  subsp. aureus ATCC 51811
MEHTTMKMAAIAKASLALGILATGTITSLHQTVNASEHEAKYENVTKDIFDLRDYYSGASKELKNVTGYRYSKGGKHYLIFDKHQKFTRIQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 36064 - protein, 320 aa, Staphylococcus aureus
  subsp. aureus ATCC 51811
MEHTTMKITTIAKTSLALGLLTTGVITTTTQAANATTPPSTKVETPQQVANATTPSSTKVEAPQQAANATTPSSTKVEAPQSKPNATTPSSTKVEAPQQAANATTPPSSNVDTSPPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 36065 - protein, 356 aa, Staphylococcus aureus; identical to SEQ ID NO: 31598
  subsp. aureus ATCC 51811

SEQ ID NO: 36066 - protein, 251 aa, Staphylococcus aureus
  subsp. aureus ATCC 51811
MYGSNYVIKQSNYNRLEHTAMKMKSIVKISLLLGILATGVNTTTEKPVHAEKKPIVISENSKKLKAYYTQPSIEYKNVTGYISFIQPSIKFMNIIDGNSVNNIALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 36067 - protein, 226 aa, Staphylococcus aureus; identical to SEQ ID NO: 31343
  subsp. aureus ATCC 51811

SEQ ID NO: 36068 - protein, 203 aa, Staphylococcus aureus; identical to SEQ ID NO: 31344
  subsp. aureus ATCC 51811

SEQ ID NO: 36069 - protein, 690 aa, Staphylococcus aureus; identical to SEQ ID NO: 31345
  subsp. aureus ATCC 51811

SEQ ID NO: 36070 - protein, 241 aa, Staphylococcus aureus; identical to SEQ ID NO: 31350
  subsp. aureus ATCC 51811

SEQ ID NO: 36071 - protein, 520 aa, Staphylococcus aureus
  subsp. aureus ATCC 51811
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDGNKPGKEDNNKPGKEDNKKPGKEDGNKPGKEDNKKPGKEDGNKPGKEDNNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 36072 - protein, 62 aa, Staphylococcus aureus; identical to SEQ ID NO: 31608
  subsp. aureus ATCC 51811

SEQ ID NO: 36073 - protein, 241 aa, Staphylococcus aureus; identical to SEQ ID NO: 30411
  subsp. aureus ATCC 51811

SEQ ID NO: 36074 - protein, 1183 aa, Staphylococcus aureus
  subsp. aureus ATCC 51811
MNKNVLKFMVFIMLLNIITPLFNKNEALAARDISSTNVTDLTVSPTKIEDGGKTTVKMTFDDKSVKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGTANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPETTSISGEKVWDDKDNQDGKRPEKVSVNLLANGEKVKAVDVTSETNWKYEFKDLPKYDEGKKIEYTVTEDHVKDYTTDINGTTITNKYTPGETSATVTKNWDDNNNQDGKRPTEIKVELYQDGKATGKTAKLNESNNWTHTWTGLDEKAKGQQVKYTVEELTKVKGYTTHVDNNDMGNLIVTNKYTPETTSINGEKVWDDKDNQDGKRPEKVSINLLANGEKVKTLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 36075 - protein, 681 aa, Staphylococcus aureus; identical to SEQ ID NO: 32025
  subsp. aureus ATCC 51811

SEQ ID NO: 36076 - protein, 698 aa, Staphylococcus aureus
  subsp. aureus ATCC 51811
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDKTGKNLKTQVIQENVDPATGKDYSIFGWNNENVVRYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSESDSDSDSDSDSDSESDS

SEQ ID NO: 36077 - protein, 198 aa, Staphylococcus aureus; identical to SEQ ID NO: 31544
  subsp. aureus ATCC 51811

SEQ ID NO: 36078 - protein, 233 aa, Staphylococcus aureus; identical to SEQ ID NO: 30428
  subsp. aureus ATCC 51811

SEQ ID NO: 36079 - protein, 1023 aa, Staphylococcus aureus
  subsp. aureus ATCC 51811
MHLKGDIIVKNNLRYGIRKHKLGAASVFLGTMIVVGMGQDKEAAASEQKTTTVEENGNSATENKVNETQTTTTNVNTIDETQSYSATATEQPSNATQVTTEEAPKAVQAPQTAQPANLETVKEEVVKEEAKPQVKETTQSQDNSGDQRQVDLTPKKATQNQVAETQVEVAQPRTASESKPRVTRSADVVEAKEASDEKVETGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQNNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHTEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 36080 - protein, 957 aa, Staphylococcus aureus; identical to SEQ ID NO: 31280
  subsp. aureus ATCC 51811

SEQ ID NO: 36081 - protein, 499 aa, Staphylococcus aureus
  subsp. aureus ATCC 51811
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEF

SEQ ID NO: 36082 - protein, 107 aa, Staphylococcus aureus; identical to SEQ ID NO: 35348
  subsp. aureus ATCC 51811

SEQ ID NO: 36083 - protein, 325 aa, Staphylococcus aureus; identical to SEQ ID NO: 30407
  subsp. aureus ATCC 51811

SEQ ID NO: 36084 - protein, 315 aa, Staphylococcus aureus; identical to SEQ ID NO: 30573
  subsp. aureus ATCC 51811

SEQ ID NO: 36085 - protein, 321 aa, Staphylococcus aureus; identical to SEQ ID NO: 30959
  subsp. aureus ATCC 51811

SEQ ID NO: 36086 - protein, 141 aa, Staphylococcus aureus; identical to SEQ ID NO: 30633
  subsp. aureus ATCC 51811

SEQ ID NO: 36087 - protein, 815 aa, Staphylococcus aureus; identical to SEQ ID NO: 31288
  subsp. aureus ATCC 51811

SEQ ID NO: 36088 - protein, 2501 aa, Staphylococcus aureus
  subsp. aureus ATCC 51811
MNLFRQQKFSIRKFNVGIFSALIATVTFISINPTTASAAEQNQPAQNQPAQPADANAQPNANAGAQANPAAQPAAPANQGQPAAQPANQGGQANPAGGAAQPAGGAAQPAAGTAQPAGQGNQADPNNAAQAQPGNQAAPANQAGQGNNQATPANQTQPANAPAAQPAAPVAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYINDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVEAAQKQGLHDIQVVKSKQEVADTKSKVLDKINAIQTQAKVKPAADTEVENAYNTRKQEIQNSNASTTEEKQAAYTELDTKKQEARTNLDAANTNSAVTTAKDNGIAAINQVQAATTKKSDAKAEIAQKASERKTAIEAMNDSTTEEQQAAKEKVDQAVLSANADIDNAAANTDVDNAKTTNEATIAAITPDANVKPQAKQAIADKVQAQEKAIDANNGSTTEEKAAAKQQVQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKAIQAIAAATTNAQVDEAKTNAEAAINAVTPKVVKKQTAKDEIDQLQATQTNVINNDQNATTEEKEAAIQQLATAVTDAKNNITAATDDNGVDQAKDAGKNSIQSTQPATSVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTTTAPTTASTEAASSADSKDNASVNDSKQNAEVNNSAESQSTNGKVAQPKSENKAKAEKDGRDSTNQSMVESTTETLPSADITEPNVPSNTSKDKEESTSNQTDAGQLKSETNVASNEADKSPSKADTEVSNKPSTSASSEAKEKMTSTNVSQKDDTATADTNDMQTSVGSVANNKAKDMQTNDTQTSVGPVANNKATQNDGANASPATVSNGSHSMHQDMLNVTKTEENKANAKSDQQGKVNKPKQQAKTLPDTGMSHNDDLPYAELALGAGMAFLIRRFTKKDQQTEE

SEQ ID NO: 36089 - protein, 231 aa, Staphylococcus aureus; identical to SEQ ID NO: 31073
  subsp. aureus ATCC 51811

SEQ ID NO: 36090 - protein, 96 aa, Staphylococcus aureus; identical to SEQ ID NO: 30813
  subsp. aureus ATCC BAA-39

SEQ ID NO: 36091 - protein, 257 aa, Staphylococcus aureus; identical to SEQ ID NO: 30259
  subsp. aureus ATCC BAA-39

SEQ ID NO: 36092 - protein, 274 aa, Staphylococcus aureus; identical to SEQ ID NO: 30872
  subsp. aureus ATCC BAA-39

SEQ ID NO: 36093 - protein, 338 aa, Staphylococcus aureus; identical to SEQ ID NO: 30699
  subsp. aureus ATCC BAA-39

SEQ ID NO: 36094 - protein, 351 aa, Staphylococcus aureus; identical to SEQ ID NO: 30720
  subsp. aureus ATCC BAA-39

SEQ ID NO: 36095 - protein, 231 aa, Staphylococcus aureus; identical to SEQ ID NO: 31073
  subsp. aureus ATCC BAA-39

SEQ ID NO: 36096 - protein, 1789 aa, Staphylococcus aureus
  subsp. aureus ATCC BAA-39
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNDNTR

SEQ ID NO: 36097 - protein, 807 aa, Staphylococcus aureus; identical to SEQ ID NO: 30716
  subsp. aureus ATCC BAA-39

SEQ ID NO: 36098 - protein, 141 aa, Staphylococcus aureus; identical to SEQ ID NO: 30715
  subsp. aureus ATCC BAA-39

SEQ ID NO: 36099 - protein, 321 aa, Staphylococcus aureus; identical to SEQ ID NO: 30959
  subsp. aureus ATCC BAA-39

SEQ ID NO: 36100 - protein, 318 aa, Staphylococcus aureus
  subsp. aureus ATCC BAA-39
MKLMLKNKILTTTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 36101 - protein, 325 aa, Staphylococcus aureus; identical to SEQ ID NO: 30407
  subsp. aureus ATCC BAA-39

SEQ ID NO: 36102 - protein, 196 aa, Staphylococcus aureus; identical to SEQ ID NO: 30587
  subsp. aureus ATCC BAA-39

SEQ ID NO: 36103 - protein, 127 aa, Staphylococcus aureus
  subsp. aureus ATCC BAA-39
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEV

SEQ ID NO: 36104 - protein, 940 aa, Staphylococcus aureus
  subsp. aureus ATCC BAA-39
MKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVECDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 36105 - protein, 1026 aa, Staphylococcus aureus
  subsp. aureus ATCC BAA-39
MHLKGDIIVKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 36106 - protein, 233 aa, Staphylococcus aureus; identical to SEQ ID NO: 31039
  subsp. aureus ATCC BAA-39

SEQ ID NO: 36107 - protein, 927 aa, Staphylococcus aureus
  subsp. aureus ATCC BAA-39
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 36108 - protein, 1759 aa, Staphylococcus aureus; identical to SEQ ID NO: 31045
  subsp. aureus ATCC BAA-39

SEQ ID NO: 36109 - protein, 681 aa, Staphylococcus aureus; identical to SEQ ID NO: 31046
  subsp. aureus ATCC BAA-39

SEQ ID NO: 36110 - protein, 809 aa, Staphylococcus aureus; identical to SEQ ID NO: 31961
  subsp. aureus ATCC BAA-39

SEQ ID NO: 36111 - protein, 190 aa, Staphylococcus aureus; identical to SEQ ID NO: 30534
  subsp. aureus ATCC BAA-39

SEQ ID NO: 36112 - protein, 147 aa, Staphylococcus aureus
  subsp. aureus ATCC BAA-39
DGNKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 36113 - protein, 299 aa, Staphylococcus aureus
  subsp. aureus ATCC BAA-39
MMTLQIHTGGINLKKKNIYSIRKLGVGIASVTLGTLLISGGVTPAANVAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKE

SEQ ID NO: 36114 - protein, 221 aa, Staphylococcus aureus; identical to SEQ ID NO: 31036
  subsp. aureus ATCC BAA-39

SEQ ID NO: 36115 - protein, 691 aa, Staphylococcus aureus; identical to SEQ ID NO: 31040
  subsp. aureus ATCC BAA-39

SEQ ID NO: 36116 - protein, 203 aa, Staphylococcus aureus; identical to SEQ ID NO: 30770
  subsp. aureus ATCC BAA-39

SEQ ID NO: 36117 - protein, 226 aa, Staphylococcus aureus; identical to SEQ ID NO: 30769
  subsp. aureus ATCC BAA-39

SEQ ID NO: 36118 - protein, 231 aa, Staphylococcus aureus; identical to SEQ ID NO: 30768
  subsp. aureus ATCC BAA-39

SEQ ID NO: 36119 - protein, 352 aa, Staphylococcus aureus; identical to SEQ ID NO: 30767
  subsp. aureus ATCC BAA-39

SEQ ID NO: 36120 - protein, 308 aa, Staphylococcus aureus; identical to SEQ ID NO: 31787
  subsp. aureus ATCC BAA-39

SEQ ID NO: 36121 - protein, 239 aa, Staphylococcus aureus; identical to SEQ ID NO: 31982
  subsp. aureus ATCC BAA-39

SEQ ID NO: 36122 - protein, 231 aa, Staphylococcus aureus; identical to SEQ ID NO: 31761
  subsp. aureus ATCC BAA-39

SEQ ID NO: 36123 - protein, 231 aa, Staphylococcus aureus; identical to SEQ ID NO: 30560
  subsp. aureus ATCC BAA-39

SEQ ID NO: 36124 - protein, 232 aa, Staphylococcus aureus
  subsp. aureus ATCC BAA-39
MEFTVIAKAIFILGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 36125 - protein, 232 aa, Staphylococcus aureus; identical to SEQ ID NO: 30765
  subsp. aureus ATCC BAA-39

SEQ ID NO: 36126 - protein, 227 aa, Staphylococcus aureus; identical to SEQ ID NO: 30585
  subsp. aureus ATCC BAA-39

SEQ ID NO: 36127 - protein, 225 aa, Staphylococcus aureus; identical to SEQ ID NO: 30763
  subsp. aureus ATCC BAA-39

SEQ ID NO: 36128 - protein, 314 aa, Staphylococcus aureus; identical to SEQ ID NO: 36031
  subsp. aureus ATCC BAA-39

SEQ ID NO: 36129 - protein, 327 aa, Staphylococcus aureus; identical to SEQ ID NO: 30538
  subsp. aureus ATCC BAA-39

SEQ ID NO: 36130 - protein, 331 aa, Staphylococcus aureus; identical to SEQ ID NO: 30732
  subsp. aureus ATCC BAA-39

SEQ ID NO: 36131 - protein, 2186 aa, Staphylococcus aureus; identical to SEQ ID NO: 31059
  subsp. aureus ATCC BAA-39

SEQ ID NO: 36132 - protein, 704 aa, Staphylococcus aureus
  subsp. aureus ATCC BAA-39
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKEM

SEQ ID NO: 36133 - protein, 291 aa, Staphylococcus aureus; identical to SEQ ID NO: 30390
  subsp. aureus ATCC BAA-39

SEQ ID NO: 36134 - protein, 250 aa, Staphylococcus aureus; identical to SEQ ID NO: 31910
  subsp. aureus ATCC BAA-39

SEQ ID NO: 36135 - protein, 2355 aa, Staphylococcus aureus
  subsp. aureus ATCC BAA-39
MNYRDKIQKFSIRKYTVGTFSTVIATLVFLGFNTSQAHAAETNQPASVVKQKQQSNNEQTENRESQVQNSQNSQNGQSLSATHENEQPNISQANLVDQKVAQSSTTNDEQPASQNVNTKKDSATAATTQPDKEQSKHKQNESQSANKNGNDNRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPHRSHDFKIRNRSGQVIYDWPTVHIYSLEDLSRASDYFSEAGATPATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYSNNANTNAFRPGGAQQLNEYQLSQLFTDQKLQEAARTRNPIRLMIGFDYPDAYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRPNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIRPQDYIVFIPPVGKQIRAVVYYNKVVASNMSNAVTILPDDIPPTINNPVGINAKYYRGDEVNFTMGVSDRHSGIKNTTITTLPNGWTSNLTKADKNNGSLSITGRVSMNQAFNSDITFKVSATDNVNNTTNDSQSKHVSIHVGKISEDAHPIVLGNTEKVVVVNPTAVSNDEKQSIITAFMNKNQNIRGYLASTDPVTVDNNGNVTLHYRDGSSTTLDATNVMTYEPVVKPEYQTVNAAKTATVTIAKGQSFSIGDIKQYFTLSNGQPIPSGTFTNITSDRTIPTAQEVSQMNAGTQLYHITATNAYHKDSEDFYISLKIIDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKSQAEAGGRPNFRTTGYSQSNATTDGQRQFTLNGQVIQVLDIINPSNGYGGQPVTNSNTRANHSNSTVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPNTSQITGTVDNNHQHVSATAPNVTSATNKTINLLATDTSGNTATTSFNVTVKPLRDKYRVGTSSTAANPVRIANISNNATVSQADQTTIINSLTFTETVPNRSYARASANEITSKTVSNVSRTGNNANVTVTVTYQDGTTSTVTVPVKHVIPEIVAHSHYTVQGQDFPAGNGSSASDYFKLSNGSDIADATITWVSGQAPNKDNTRIGEDITVTAHILIDGETTPITKTATYKVVRTVPKHVFETARGVLYPGVSDMYDAKQYVKPVNNSWSTNAQHMNFQFVGTYGPNKDVVGISTRLIRVTYDNRQTEDLTILSKVKPDPPRIDANSVTYKAGLTNQEIKVNNVLNNSSVKLFKADNTPLNVTNITHGSGFSSVVTVSDALPNGGIKAKSSISMNNVTYTTQDEHGQVVTVTRNESVDSNDSATVTVTPQLQATTEGAVFIKGGDGFDFGHVERFIQNPPHGATVAWHDSPDTWKNTVGNTHKTAVVTLPNGQGTRNVEVPVKVYPVANAKAPSRDVKGQNLTNGTDAMNYITFDPNTNTNGITAAWANRQQPNNQQAGVQHLNVDVTYPGISAAKRVPVTVNVYQFEFPQTTYTTTVGGTLASGTQASGYAHMQNATGLPTDGFTYKWNRDTTGTNDANWSAMNKPNVAKVVNAKYDVIYNGHTFATSLPAKFVVKDVQPAKPTVTETAAGAITIAPGANQTVNTHAGNVTTYADKLVIKRNGNVVTTFTRRNNTSPWVKEASAATVAGIAGTNNGITVAAGTFNPADTIQVVATQGSGETVSDEQRSDDFTVVAPQPNQATTKIWQNGHIDITPNNPSGHLINPT

SEQ ID NO: 36136 - protein, 372 aa, Staphylococcus aureus; identical to SEQ ID NO: 31084
  subsp. aureus ATCC BAA-39

SEQ ID NO: 36137 - protein, 241 aa, Staphylococcus aureus; identical to SEQ ID NO: 30738
  subsp. aureus ATCC BAA-39

SEQ ID NO: 36138 - protein, 241 aa, Staphylococcus aureus; identical to SEQ ID NO: 30739
  subsp. aureus ATCC BAA-39

SEQ ID NO: 36139 - protein, 271 aa, Staphylococcus aureus
  subsp. aureus ATCC BAA-39
MELIKIIANTILTSLTFKFLIPRIMIPLKGDVLMSKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 36140 - protein, 322 aa, Staphylococcus aureus
  subsp. aureus ATCC BAA-39
MMKMKTHIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 36141 - protein, 165 aa, Staphylococcus aureus; identical to SEQ ID NO: 30742
  subsp. aureus ATCC BAA-39

SEQ ID NO: 36142 - protein, 109 aa, Staphylococcus aureus; identical to SEQ ID NO: 30744
  subsp. aureus ATCC BAA-39

SEQ ID NO: 36143 - protein, 350 aa, Staphylococcus aureus
  subsp. aureus ATCC BAA-39
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFCKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 36144 - protein, 645 aa, Staphylococcus aureus; identical to SEQ ID NO: 30747
  subsp. aureus ATCC BAA-39

SEQ ID NO: 36145 - protein, 256 aa, Staphylococcus aureus
  subsp. aureus ATCC BAA-39
MPIWRCNIKKGAIKMNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNILINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYNDNKTIDAENFHLDVEISYEKTE

SEQ ID NO: 36146 - protein, 242 aa, Staphylococcus aureus; identical to SEQ ID NO: 30396
  subsp. aureus ATCC BAA-39

SEQ ID NO: 36147 - protein, 915 aa, Staphylococcus aureus
  subsp. aureus ATCC BAA-39
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYINPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 36148 - protein, 434 aa, Staphylococcus aureus [sequence omitted]

SEQ ID NO: 36149 - protein, 1161 aa, Staphylococcus aureus
  subsp. aureus ATCC BAA-39
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 36150 - protein, 1381 aa, Staphylococcus aureus; identical to SEQ ID NO: 30760
  subsp. aureus ATCC BAA-39

SEQ ID NO: 36151 - protein, 923 aa, Staphylococcus aureus; identical to SEQ ID NO: 31930
  subsp. aureus ATCC BAA-39

SEQ ID NO: 36152 - protein, 786 aa, Staphylococcus aureus
  subsp. aureus Btn1260
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSE

SEQ ID NO: 36153 - protein, 114 aa, Staphylococcus aureus
  subsp. aureus Btn1260
SDSDSDSDSDSESDSDSDSDSESDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 36154 - protein, 1374 aa, Staphylococcus aureus
  subsp. aureus Btn1260
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 36155 - protein, 1137 aa, Staphylococcus aureus; identical to SEQ ID NO: 31254
  subsp. aureus Btn1260

SEQ ID NO: 36156 - protein, 434 aa, Staphylococcus aureus [sequence omitted]

SEQ ID NO: 36157 - protein, 631 aa, Staphylococcus aureus
  subsp. aureus Btn1260
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDS

SEQ ID NO: 36158 - protein, 652 aa, Staphylococcus aureus; identical to SEQ ID NO: 34746
  subsp. aureus Btn1260

SEQ ID NO: 36159 - protein, 354 aa, Staphylococcus aureus; identical to SEQ ID NO: 30412
  subsp. aureus Btn1260

SEQ ID NO: 36160 - protein, 105 aa, Staphylococcus aureus; identical to SEQ ID NO: 31168
  subsp. aureus Btn1260

SEQ ID NO: 36161 - protein, 165 aa, Staphylococcus aureus; identical to SEQ ID NO: 31241
  subsp. aureus Btn1260

SEQ ID NO: 36162 - protein, 206 aa, Staphylococcus aureus; identical to SEQ ID NO: 34750
  subsp. aureus Btn1260

SEQ ID NO: 36163 - protein, 238 aa, Staphylococcus aureus; identical to SEQ ID NO: 31240
  subsp. aureus Btn1260

SEQ ID NO: 36164 - protein, 241 aa, Staphylococcus aureus; identical to SEQ ID NO: 31239
  subsp. aureus Btn1260

SEQ ID NO: 36165 - protein, 241 aa, Staphylococcus aureus; identical to SEQ ID NO: 31173
  subsp. aureus Btn1260

SEQ ID NO: 36166 - protein, 372 aa, Staphylococcus aureus; identical to SEQ ID NO: 33950
  subsp. aureus Btn1260

SEQ ID NO: 36167 - protein, 151 aa, Staphylococcus aureus; identical to SEQ ID NO: 35733
  subsp. aureus Btn1260

SEQ ID NO: 36168 - protein, 291 aa, Staphylococcus aureus; identical to SEQ ID NO: 30390
  subsp. aureus Btn1260

SEQ ID NO: 36169 - protein, 2187 aa, Staphylococcus aureus
  subsp. aureus Btn1260
MLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMVDEDATLNDIKKDTQLIIDEILAIKLPAEVIKASPKVGQPAPKVCTPIKKEDKQEVRKVVKELPNTGSEEMDLPLKELALITGAALLARRRSKKEKES

SEQ ID NO: 36170 - protein, 331 aa, Staphylococcus aureus; identical to SEQ ID NO: 31235
  subsp. aureus Btn1260

SEQ ID NO: 36171 - protein, 808 aa, Staphylococcus aureus; identical to SEQ ID NO: 35997
  subsp. aureus Btn1260

SEQ ID NO: 36172 - protein, 258 aa, Staphylococcus aureus; identical to SEQ ID NO: 30518
  subsp. aureus Btn1260

SEQ ID NO: 36173 - protein, 251 aa, Staphylococcus aureus; identical to SEQ ID NO: 30505
  subsp. aureus Btn1260

SEQ ID NO: 36174 - protein, 261 aa, Staphylococcus aureus; identical to SEQ ID NO: 30506
  subsp. aureus Btn1260

SEQ ID NO: 36175 - protein, 242 aa, Staphylococcus aureus; identical to SEQ ID NO: 30522
  subsp. aureus Btn1260

SEQ ID NO: 36176 - protein, 239 aa, Staphylococcus aureus; identical to SEQ ID NO: 30171
  subsp. aureus Btn1260

SEQ ID NO: 36177 - protein, 254 aa, Staphylococcus aureus; identical to SEQ ID NO: 31226
  subsp. aureus Btn1260

SEQ ID NO: 36178 - protein, 689 aa, Staphylococcus aureus; identical to SEQ ID NO: 31861
  subsp. aureus Btn1260

SEQ ID NO: 36179 - protein, 282 aa, Staphylococcus aureus
  subsp. aureus Btn1260
RLYVIDRFVSKLGGQYKRAYLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTEEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 36180 - protein, 339 aa, Staphylococcus aureus; identical to SEQ ID NO: 31219
  subsp. aureus Btn1260

SEQ ID NO: 36181 - protein, 351 aa, Staphylococcus aureus; identical to SEQ ID NO: 31218
  subsp. aureus Btn1260

SEQ ID NO: 36182 - protein, 234 aa, Staphylococcus aureus; identical to SEQ ID NO: 30530
  subsp. aureus Btn1260

SEQ ID NO: 36183 - protein, 44 aa, Staphylococcus aureus; identical to SEQ ID NO: 30513
  subsp. aureus Btn1260

SEQ ID NO: 36184 - protein, 231 aa, Staphylococcus aureus; identical to SEQ ID NO: 31216
  subsp. aureus Btn1260

SEQ ID NO: 36185 - protein, 520 aa, Staphylococcus aureus
  subsp. aureus Btn1260
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 36186 - protein, 221 aa, Staphylococcus aureus; identical to SEQ ID NO: 31036
  subsp. aureus Btn1260

SEQ ID NO: 36187 - protein, 691 aa, Staphylococcus aureus; identical to SEQ ID NO: 31040
  subsp. aureus Btn1260

SEQ ID NO: 36188 - protein, 226 aa, Staphylococcus aureus; identical to SEQ ID NO: 31265
  subsp. aureus Btn1260

SEQ ID NO: 36189 - protein, 231 aa, Staphylococcus aureus; identical to SEQ ID NO: 35706
  subsp. aureus Btn1260

SEQ ID NO: 36190 - protein, 343 aa, Staphylococcus aureus; identical to SEQ ID NO: 31263
  subsp. aureus Btn1260

SEQ ID NO: 36191 - protein, 325 aa, Staphylococcus aureus; identical to SEQ ID NO: 33964
  subsp. aureus Btn1260

SEQ ID NO: 36192 - protein, 234 aa, Staphylococcus aureus; identical to SEQ ID NO: 30567
  subsp. aureus Btn1260

SEQ ID NO: 36193 - protein, 231 aa, Staphylococcus aureus; identical to SEQ ID NO: 30566
  subsp. aureus Btn1260

SEQ ID NO: 36194 - protein, 232 aa, Staphylococcus aureus; identical to SEQ ID NO: 30565
  subsp. aureus Btn1260

SEQ ID NO: 36195 - protein, 227 aa, Staphylococcus aureus; identical to SEQ ID NO: 30564
  subsp. aureus Btn1260

SEQ ID NO: 36196 - protein, 232 aa, Staphylococcus aureus; identical to SEQ ID NO: 31257
  subsp. aureus Btn1260

SEQ ID NO: 36197 - protein, 808 aa, Staphylococcus aureus; identical to SEQ ID NO: 31215
  subsp. aureus Btn1260

SEQ ID NO: 36198 - protein, 141 aa, Staphylococcus aureus; identical to SEQ ID NO: 31214
  subsp. aureus Btn1260

SEQ ID NO: 36199 - protein, 321 aa, Staphylococcus aureus; identical to SEQ ID NO: 31900
  subsp. aureus Btn1260

SEQ ID NO: 36200 - protein, 315 aa, Staphylococcus aureus; identical to SEQ ID NO: 31191
  subsp. aureus Btn1260

SEQ ID NO: 36201 - protein, 325 aa, Staphylococcus aureus; identical to SEQ ID NO: 30479
  subsp. aureus Btn1260

SEQ ID NO: 36202 - protein, 942 aa, Staphylococcus aureus; identical to SEQ ID NO: 35550
  subsp. aureus Btn1260

SEQ ID NO: 36203 - protein, 233 aa, Staphylococcus aureus; identical to SEQ ID NO: 31039
  subsp. aureus Btn1260

SEQ ID NO: 36204 - protein, 879 aa, Staphylococcus aureus; identical to SEQ ID NO: 34708
  subsp. aureus Btn1260

SEQ ID NO: 36205 - protein, 1351 aa, Staphylococcus aureus; identical to SEQ ID NO: 31203
  subsp. aureus Btn1260

SEQ ID NO: 36206 - protein, 681 aa, Staphylococcus aureus; identical to SEQ ID NO: 34710
  subsp. aureus Btn1260

SEQ ID NO: 36207 - protein, 674 aa, Staphylococcus aureus
  subsp. aureus Btn1260
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNWTHTW

SEQ ID NO: 36208 - protein, 197 aa, Staphylococcus aureus
  subsp. aureus Btn1260
HLKQTGSTNLKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEF

SEQ ID NO: 36209 - protein, 233 aa, Staphylococcus aureus; identical to SEQ ID NO: 31039
  subsp. aureus C101

SEQ ID NO: 36210 - protein, 639 aa, Staphylococcus aureus
  subsp. aureus C101
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSD

SEQ ID NO: 36211 - protein, 1731 aa, Staphylococcus aureus; identical to SEQ ID NO: 35821
  subsp. aureus C101

SEQ ID NO: 36212 - protein, 681 aa, Staphylococcus aureus; identical to SEQ ID NO: 31046
  subsp. aureus C101

SEQ ID NO: 36213 - protein, 102 aa, Staphylococcus aureus
  subsp. aureus C101
MGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 36214 - protein, 581 aa, Staphylococcus aureus; identical to SEQ ID NO: 35701
  subsp. aureus C101

SEQ ID NO: 36215 - protein, 453 aa, Staphylococcus aureus; identical to SEQ ID NO: 35702
  subsp. aureus C101

SEQ ID NO: 36216 - protein, 221 aa, Staphylococcus aureus; identical to SEQ ID NO: 31036
  subsp. aureus C101

SEQ ID NO: 36217 - protein, 691 aa, Staphylococcus aureus; identical to SEQ ID NO: 31040
  subsp. aureus C101

SEQ ID NO: 36218 - protein, 226 aa, Staphylococcus aureus; identical to SEQ ID NO: 31265
  subsp. aureus C101

SEQ ID NO: 36219 - protein, 231 aa, Staphylococcus aureus; identical to SEQ ID NO: 35706
  subsp. aureus C101

SEQ ID NO: 36220 - protein, 343 aa, Staphylococcus aureus; identical to SEQ ID NO: 31263
  subsp. aureus C101

SEQ ID NO: 36221 - protein, 304 aa, Staphylococcus aureus; identical to SEQ ID NO: 35708
  subsp. aureus C101

SEQ ID NO: 36222 - protein, 234 aa, Staphylococcus aureus; identical to SEQ ID NO: 30567
  subsp. aureus C101

SEQ ID NO: 36223 - protein, 231 aa, Staphylococcus aureus; identical to SEQ ID NO: 30566
  subsp. aureus C101

SEQ ID NO: 36224 - protein, 232 aa, Staphylococcus aureus; identical to SEQ ID NO: 30565
  subsp. aureus C101

SEQ ID NO: 36225 - protein, 227 aa, Staphylococcus aureus; identical to SEQ ID NO: 30564
  subsp. aureus C101

SEQ ID NO: 36226 - protein, 232 aa, Staphylococcus aureus; identical to SEQ ID NO: 31257
  subsp. aureus C101

SEQ ID NO: 36227 - protein, 434 aa, Staphylococcus aureus [sequence omitted]

SEQ ID NO: 36228 - protein, 969 aa, Staphylococcus aureus
  subsp. aureus C101
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 36229 - protein, 708 aa, Staphylococcus aureus
  subsp. aureus C101
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYDNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEET

SEQ ID NO: 36230 - protein, 54 aa, Staphylococcus aureus; identical to SEQ ID NO: 35777
  subsp. aureus C101

SEQ ID NO: 36231 - protein, 1224 aa, Staphylococcus aureus
  subsp. aureus C101
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSESDSDSDSDSDSDSDSDSDSDSDSESDSDSESDSDSDSDSDSDSDSDSDSDSDSDSDSDSDSDSDSD

SEQ ID NO: 36232 - protein, 1155 aa, Staphylococcus aureus
  subsp. aureus C101
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPDEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 36233 - protein, 648 aa, Staphylococcus aureus; identical to SEQ ID NO: 31909
  subsp. aureus C101

SEQ ID NO: 36234 - protein, 354 aa, Staphylococcus aureus; identical to SEQ ID NO: 30412
  subsp. aureus C101

SEQ ID NO: 36235 - protein, 105 aa, Staphylococcus aureus; identical to SEQ ID NO: 31168
  subsp. aureus C101

SEQ ID NO: 36236 - protein, 165 aa, Staphylococcus aureus; identical to SEQ ID NO: 31241
  subsp. aureus C101

SEQ ID NO: 36237 - protein, 319 aa, Staphylococcus aureus; identical to SEQ ID NO: 33985
  subsp. aureus C101

SEQ ID NO: 36238 - protein, 238 aa, Staphylococcus aureus; identical to SEQ ID NO: 31240
  subsp. aureus C101

SEQ ID NO: 36239 - protein, 241 aa, Staphylococcus aureus; identical to SEQ ID NO: 31239
  subsp. aureus C101

SEQ ID NO: 36240 - protein, 241 aa, Staphylococcus aureus; identical to SEQ ID NO: 31173
  subsp. aureus C101

SEQ ID NO: 36241 - protein, 176 aa, Staphylococcus aureus; identical to SEQ ID NO: 35732
  subsp. aureus C101

SEQ ID NO: 36242 - protein, 325 aa, Staphylococcus aureus; identical to SEQ ID NO: 30484
  subsp. aureus C101

SEQ ID NO: 36243 - protein, 315 aa, Staphylococcus aureus; identical to SEQ ID NO: 35728
  subsp. aureus C101

SEQ ID NO: 36244 - protein, 151 aa, Staphylococcus aureus; identical to SEQ ID NO: 35733
  subsp. aureus C101

SEQ ID NO: 36245 - protein, 291 aa, Staphylococcus aureus; identical to SEQ ID NO: 30390
  subsp. aureus C101

SEQ ID NO: 36246 - protein, 890 aa, Staphylococcus aureus; identical to SEQ ID NO: 35735
  subsp. aureus C101

SEQ ID NO: 36247 - protein, 2035 aa, Staphylococcus aureus; identical to SEQ ID NO: 35736
  subsp. aureus C101

SEQ ID NO: 36248 - protein, 331 aa, Staphylococcus aureus; identical to SEQ ID NO: 31235
  subsp. aureus C101

SEQ ID NO: 36249 - protein, 808 aa, Staphylococcus aureus; identical to SEQ ID NO: 35738
  subsp. aureus C101

SEQ ID NO: 36250 - protein, 258 aa, Staphylococcus aureus; identical to SEQ ID NO: 30518
  subsp. aureus C101

SEQ ID NO: 36251 - protein, 251 aa, Staphylococcus aureus; identical to SEQ ID NO: 30505
  subsp. aureus C101

SEQ ID NO: 36252 - protein, 261 aa, Staphylococcus aureus; identical to SEQ ID NO: 30506
  subsp. aureus C101

SEQ ID NO: 36253 - protein, 242 aa, Staphylococcus aureus; identical to SEQ ID NO: 30522
  subsp. aureus C101

SEQ ID NO: 36254 - protein, 239 aa, Staphylococcus aureus; identical to SEQ ID NO: 35743
  subsp. aureus C101

SEQ ID NO: 36255 - protein, 254 aa, Staphylococcus aureus; identical to SEQ ID NO: 31226
  subsp. aureus C101

SEQ ID NO: 36256 - protein, 689 aa, Staphylococcus aureus; identical to SEQ ID NO: 31861
  subsp. aureus C101

SEQ ID NO: 36257 - protein, 274 aa, Staphylococcus aureus; identical to SEQ ID NO: 33993
  subsp. aureus C101

SEQ ID NO: 36258 - protein, 339 aa, Staphylococcus aureus; identical to SEQ ID NO: 31219
  subsp. aureus C101

SEQ ID NO: 36259 - protein, 351 aa, Staphylococcus aureus; identical to SEQ ID NO: 33991
  subsp. aureus C101

SEQ ID NO: 36260 - protein, 231 aa, Staphylococcus aureus; identical to SEQ ID NO: 31216
  subsp. aureus C101

SEQ ID NO: 36261 - protein, 808 aa, Staphylococcus aureus; identical to SEQ ID NO: 31215
  subsp. aureus C101

SEQ ID NO: 36262 - protein, 141 aa, Staphylococcus aureus; identical to SEQ ID NO: 31214
  subsp. aureus C101

SEQ ID NO: 36263 - protein, 321 aa, Staphylococcus aureus; identical to SEQ ID NO: 31900
  subsp. aureus C101

SEQ ID NO: 36264 - protein, 305 aa, Staphylococcus aureus
  subsp. aureus C101
MLKNKILATTLSVSLLAPLANPLLENAKAANDTEDIGKGNDVEIIKRTEDKTSNKWGVTQNIQFDFVKDKKYNKDALILKMQGFISSRTTYYNYKNTNHIKSMRWPFQYNIGLKTNDKYVSLINYLPKNKIESTNVSQTLGYNIGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFKNRNYTVKYEVNWKTHEIKVKGQN

SEQ ID NO: 36265 - protein, 325 aa, Staphylococcus aureus; identical to SEQ ID NO: 30479
  subsp. aureus C101

SEQ ID NO: 36266 - protein, 105 aa, Staphylococcus aureus
  subsp. aureus C101
MPSEPGKPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 36267 - protein, 705 aa, Staphylococcus aureus
  subsp. aureus C101
MKSNLRYGIRKHKLGAASVFLGTMIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTE

SEQ ID NO: 36268 - protein, 69 aa, Staphylococcus aureus; identical to SEQ ID NO: 35756
  subsp. aureus C101

SEQ ID NO: 36269 - protein, 798 aa, Staphylococcus aureus
  subsp. aureus C101
MKNNLRYGIRKHKLGAASVFLGTMIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGVVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDT

SEQ ID NO: 36270 - protein, 808 aa, Staphylococcus aureus; identical to SEQ ID NO: 31215
  subsp. aureus C160

SEQ ID NO: 36271 - protein, 141 aa, Staphylococcus aureus; identical to SEQ ID NO: 31214
  subsp. aureus C160

SEQ ID NO: 36272 - protein, 321 aa, Staphylococcus aureus; identical to SEQ ID NO: 31900
  subsp. aureus C160

SEQ ID NO: 36273 - protein, 315 aa, Staphylococcus aureus; identical to SEQ ID NO: 31191
  subsp. aureus C160

SEQ ID NO: 36274 - protein, 325 aa, Staphylococcus aureus; identical to SEQ ID NO: 30479
  subsp. aureus C160

SEQ ID NO: 36275 - protein, 942 aa, Staphylococcus aureus
  subsp. aureus C160
MIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTLTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQAKKSELPETGGEESTNKGMLFGGLFSILGLALLRRNKKNHKA

SEQ ID NO: 36276 - protein, 233 aa, Staphylococcus aureus; identical to SEQ ID NO: 31039
  subsp. aureus C160

SEQ ID NO: 36277 - protein, 544 aa, Staphylococcus aureus
  subsp. aureus C160
FEKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSEPSVRTRAVRSLAVAEPVVNAADAKGTNVNDKVTASDFKLEKTTFDPNQSGNTFMAANFKVAGKVKSGDYFTAKLPDSVTGNGDVDYSNSNNTMPIADIVNDKKEVVAKATYDILTKTYTFVFTDYVNDKENINGQFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDINKTYVVLVEGHYDNTGKNLKTQVIQENIDPATGKDYSIFGWNNENVVRYGGGSADGDSAVNPV

SEQ ID NO: 36278 - protein, 111 aa, Staphylococcus aureus
  subsp. aureus C160
MSNSMSMSTSESNSMHPSDSMSMHHTHSTSTSISTSEATTSTSESQSTLSATSEATKHNGTRAQSEERLPDTGDSIKQNGLLGGVMTLLVGLGLMKRKKKKDENEQDDSQA

SEQ ID NO: 36279 - protein, 681 aa, Staphylococcus aureus; identical to SEQ ID NO: 35560
  subsp. aureus C160

SEQ ID NO: 36280 - protein, 246 aa, Staphylococcus aureus; identical to SEQ ID NO: 35517
  subsp. aureus C160

SEQ ID NO: 36281 - protein, 110 aa, Staphylococcus aureus
  subsp. aureus C160
KTTKKSIGINVFKNGFQQKGFVITTDKIKPIAQELDLNTRNNIQNQYKMYDSETGDIQKGYIKFHSTKSSFYYDLFDFKGKKRVDFLKFYNDNELISTKNLHIDIYLFNK

SEQ ID NO: 36282 - protein, 534 aa, Staphylococcus aureus
  subsp. aureus C160
MTLQIHTGGINLKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNKPGKEDGNKPGKEDGNKPGKEDNNKPGKEDGNKPGKEDNKKPGKEDGNKPGKEDNNKPGKEDGNKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 36283 - protein, 221 aa, Staphylococcus aureus; identical to SEQ ID NO: 31036
  subsp. aureus C160

SEQ ID NO: 36284 - protein, 691 aa, Staphylococcus aureus; identical to SEQ ID NO: 31040
  subsp. aureus C160

SEQ ID NO: 36285 - protein, 226 aa, Staphylococcus aureus; identical to SEQ ID NO: 31265
  subsp. aureus C160

SEQ ID NO: 36286 - protein, 231 aa, Staphylococcus aureus; identical to SEQ ID NO: 35706
  subsp. aureus C160

SEQ ID NO: 36287 - protein, 343 aa, Staphylococcus aureus
  subsp. aureus C160
MKIRTIAKASIALGLVTTGASIVTTQSANAEVASALKAGQLAKINVSTSAITTTAQAVNAEQNHTANPEQAAKSNTENVSTSLSTQTEQTPKSNIQKATQPAPSGTTQSLPNAQPQSTQPTPSVTTPPSSNVETPQPTSPTTKQAQKEIKPKFKGLRSYYTKSSLEFKNELGIIIKKWTTIRFMNIVPDYFIYKIALVGKDDKKYGEGVHRHVDVFIVLEQNKYGVDKYSVGGITKANRKKVDYKTGISITKEDKKGTISHDVSEYKITKEEISLKELDFKLRKQLIEQHNLYGNIGSGTIVIKMKNGGKYTFELHKKLQQHRMADVIDGTNIDRIEVNLKSS

SEQ ID NO: 36288 - protein, 325 aa, Staphylococcus aureus; identical to SEQ ID NO: 33964
  subsp. aureus C160

SEQ ID NO: 36289 - protein, 234 aa, Staphylococcus aureus; identical to SEQ ID NO: 30567
  subsp. aureus C160

SEQ ID NO: 36290 - protein, 231 aa, Staphylococcus aureus; identical to SEQ ID NO: 30566
  subsp. aureus C160

SEQ ID NO: 36291 - protein, 232 aa, Staphylococcus aureus; identical to SEQ ID NO: 30565
  subsp. aureus C160

SEQ ID NO: 36292 - protein, 227 aa, Staphylococcus aureus; identical to SEQ ID NO: 30564
  subsp. aureus C160

SEQ ID NO: 36293 - protein, 232 aa, Staphylococcus aureus; identical to SEQ ID NO: 31257
  subsp. aureus C160

SEQ ID NO: 36294 - protein, 1153 aa, Staphylococcus aureus
  subsp. aureus C160
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 36295 - protein, 1137 aa, Staphylococcus aureus; identical to SEQ ID NO: 31254
  subsp. aureus C160

SEQ ID NO: 36296 - protein, 434 aa, Staphylococcus aureus [sequence omitted]

SEQ ID NO: 36297 - protein, 993 aa, Staphylococcus aureus
  subsp. aureus C160
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSESDSDSESDSDSDSDSDSDSDSDSESDSDSDSDSDSDSDSESDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 36298 - protein, 652 aa, Staphylococcus aureus; identical to SEQ ID NO: 34746
  subsp. aureus C160

SEQ ID NO: 36299 - protein, 354 aa, Staphylococcus aureus; identical to SEQ ID NO: 30412
  subsp. aureus C160

SEQ ID NO: 36300 - protein, 105 aa, Staphylococcus aureus; identical to SEQ ID NO: 31168
  subsp. aureus C160

SEQ ID NO: 36301 - protein, 165 aa, Staphylococcus aureus
  subsp. aureus C160
MKNKLIAKSLLAIAAIGITTTTIASTADASEGYGPREKKPVSINHNIVEYNDGTFKYQSRPKFNTTPKYIKFRHDYNIVEYNDGTFEYGARPQFNKPAAKTEATIKKEQKLIQAQNLVREFEKTHTVSAHRKAQKAVNLLSFEYNVKKMILQERIDQVLKQGLVR

SEQ ID NO: 36302 - protein, 206 aa, Staphylococcus aureus; identical to SEQ ID NO: 34750
  subsp. aureus C160

SEQ ID NO: 36303 - protein, 238 aa, Staphylococcus aureus; identical to SEQ ID NO: 31240
  subsp. aureus C160

SEQ ID NO: 36304 - protein, 241 aa, Staphylococcus aureus; identical to SEQ ID NO: 31239
  subsp. aureus C160

SEQ ID NO: 36305 - protein, 241 aa, Staphylococcus aureus; identical to SEQ ID NO: 31173
  subsp. aureus C160

SEQ ID NO: 36306 - protein, 372 aa, Staphylococcus aureus
  subsp. aureus C160
MNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDMKISNTPKNSNQGNNLVVNNNEPTKEIKIANLEAQNSNQKKVNKGTNNYFGYYSFREAPKTQIYTVKKGDTLSAIALKYKTTVSNIQNTDNIANPNLIFIGQKLKVPMTPLVEPKPKTVPSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 36307 - protein, 151 aa, Staphylococcus aureus; identical to SEQ ID NO: 35733
  subsp. aureus C160

SEQ ID NO: 36308 - protein, 422 aa, Staphylococcus aureus; identical to SEQ ID NO: 35994
  subsp. aureus C160

SEQ ID NO: 36309 - protein, 291 aa, Staphylococcus aureus; identical to SEQ ID NO: 30390
  subsp. aureus C160

SEQ ID NO: 36310 - protein, 2188 aa, Staphylococcus aureus; identical to SEQ ID NO: 35519
  subsp. aureus C160

SEQ ID NO: 36311 - protein, 331 aa, Staphylococcus aureus; identical to SEQ ID NO: 31235
  subsp. aureus C160

SEQ ID NO: 36312 - protein, 808 aa, Staphylococcus aureus; identical to SEQ ID NO: 35997
  subsp. aureus C160

SEQ ID NO: 36313 - protein, 258 aa, Staphylococcus aureus; identical to SEQ ID NO: 30518
  subsp. aureus C160

SEQ ID NO: 36314 - protein, 251 aa, Staphylococcus aureus; identical to SEQ ID NO: 30505
  subsp. aureus C160

SEQ ID NO: 36315 - protein, 261 aa, Staphylococcus aureus; identical to SEQ ID NO: 30506
  subsp. aureus C160

SEQ ID NO: 36316 - protein, 242 aa, Staphylococcus aureus; identical to SEQ ID NO: 30522
  subsp. aureus C160

SEQ ID NO: 36317 - protein, 239 aa, Staphylococcus aureus; identical to SEQ ID NO: 30171
  subsp. aureus C160

SEQ ID NO: 36318 - protein, 254 aa, Staphylococcus aureus; identical to SEQ ID NO: 31226
  subsp. aureus C160

SEQ ID NO: 36319 - protein, 689 aa, Staphylococcus aureus; identical to SEQ ID NO: 31861
  subsp. aureus C160

SEQ ID NO: 36320 - protein, 274 aa, Staphylococcus aureus; identical to SEQ ID NO: 35568
  subsp. aureus C160

SEQ ID NO: 36321 - protein, 339 aa, Staphylococcus aureus; identical to SEQ ID NO: 31219
  subsp. aureus C160

SEQ ID NO: 36322 - protein, 351 aa, Staphylococcus aureus; identical to SEQ ID NO: 31218
  subsp. aureus C160

SEQ ID NO: 36323 - protein, 234 aa, Staphylococcus aureus; identical to SEQ ID NO: 30530
  subsp. aureus C160

SEQ ID NO: 36324 - protein, 231 aa, Staphylococcus aureus; identical to SEQ ID NO: 31216
  subsp. aureus C160

SEQ ID NO: 36325 - protein, 266 aa, Staphylococcus aureus; identical to SEQ ID NO: 30362
  subsp. aureus C427

SEQ ID NO: 36326 - protein, 226 aa, Staphylococcus aureus; identical to SEQ ID NO: 31265
  subsp. aureus C427

SEQ ID NO: 36327 - protein, 231 aa, Staphylococcus aureus; identical to SEQ ID NO: 35706
  subsp. aureus C427

SEQ ID NO: 36328 - protein, 343 aa, Staphylococcus aureus; identical to SEQ ID NO: 31263
  subsp. aureus C427

SEQ ID NO: 36329 - protein, 325 aa, Staphylococcus aureus; identical to SEQ ID NO: 33964
  subsp. aureus C427

SEQ ID NO: 36330 - protein, 234 aa, Staphylococcus aureus; identical to SEQ ID NO: 30567
  subsp. aureus C427

SEQ ID NO: 36331 - protein, 231 aa, Staphylococcus aureus; identical to SEQ ID NO: 30566
  subsp. aureus C427

SEQ ID NO: 36332 - protein, 232 aa, Staphylococcus aureus; identical to SEQ ID NO: 30565
  subsp. aureus C427

SEQ ID NO: 36333 - protein, 227 aa, Staphylococcus aureus; identical to SEQ ID NO: 30564
  subsp. aureus C427

SEQ ID NO: 36334 - protein, 232 aa, Staphylococcus aureus; identical to SEQ ID NO: 31257
  subsp. aureus C427

SEQ ID NO: 36335 - protein, 884 aa, Staphylococcus aureus
  subsp. aureus C427
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSESDSDSDSDSDSDSDSDSDSDSESDSDSDSDSDSDSDSDSDSDSDSESDSDSESDSDSESDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 36336 - protein, 1155 aa, Staphylococcus aureus
  subsp. aureus C427
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDAGKHTPVKPMSATKDHHNKAKALPETGSENNGSNNATLFGGLFAALGSLLLFGRRKKQNK

SEQ ID NO: 36337 - protein, 434 aa, Staphylococcus aureus
  subsp. aureus C427
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLDQPLYKYLGGFNGKQLPVPMMNIVNGGSHSDAPIAFQEFMILPVGATTFKESLRWGTEIFHNLKSILSKRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 36338 - protein, 987 aa, Staphylococcus aureus
  subsp. aureus C427
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDIDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSASDSDSDSDSDSDLDSDSDSDSDSDSDSDSASDSDSDSDSDSDSESDSDSDSDSDSDSDSASDSDSESDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 36339 - protein, 648 aa, Staphylococcus aureus; identical to SEQ ID NO: 31909
  subsp. aureus C427

SEQ ID NO: 36340 - protein, 354 aa, Staphylococcus aureus; identical to SEQ ID NO: 30412
  subsp. aureus C427

SEQ ID NO: 36341 - protein, 105 aa, Staphylococcus aureus; identical to SEQ ID NO: 31168
  subsp. aureus C427

SEQ ID NO: 36342 - protein, 165 aa, Staphylococcus aureus; identical to SEQ ID NO: 31241
  subsp. aureus C427

SEQ ID NO: 36343 - protein, 319 aa, Staphylococcus aureus
  subsp. aureus C427
MKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKVQLQLPDNEVAQISDYYPRNSIDTKEYMSTLTYGFNGNVTGDDSGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKATKQQTNINVIYERVRDDYQLHWTSTNWKGTNTKDKWTDRSSERYKIDWEKEEMTN

SEQ ID NO: 36344 - protein, 238 aa, Staphylococcus aureus; identical to SEQ ID NO: 31240
  subsp. aureus C427

SEQ ID NO: 36345 - protein, 241 aa, Staphylococcus aureus; identical to SEQ ID NO: 31239
  subsp. aureus C427

SEQ ID NO: 36346 - protein, 241 aa, Staphylococcus aureus; identical to SEQ ID NO: 31173
  subsp. aureus C427

SEQ ID NO: 36347 - protein, 372 aa, Staphylococcus aureus; identical to SEQ ID NO: 33950
  subsp. aureus C427

SEQ ID NO: 36348 - protein, 151 aa, Staphylococcus aureus; identical to SEQ ID NO: 35733
  subsp. aureus C427

SEQ ID NO: 36349 - protein, 291 aa, Staphylococcus aureus; identical to SEQ ID NO: 30390
  subsp. aureus C427

SEQ ID NO: 36350 - protein, 890 aa, Staphylococcus aureus
  subsp. aureus C427
MNKHHPKLRSFYSIRKSTLGVASVIVSTVFLITSQHQAQAAENTNTSDKISENQNNNATTTQPPKDTNQTQPATQPTNTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNTSNQNTSTTNNTNDQPQATNNMSQPAQPKASANSDQASSQPAHETNSNDNTNDATNASSNQSNGNQQYPPADESLQDAIKNPAIIDKEHTADHWRPIDFQMKNDKGERQFYHYASTVEPATVIFTKTGPIIELGLKTASTWKKFEVYEGDKKLPVELVSYDSDKDYAYIRFPVSNGAREVKIVSSIEYGENFHEDYDYTLMVFAQPITNNPDDYVDEETYNLQKLLAPYHKAKTLERQVYELEKLQDKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDPKNNSRTLIFPYVPDKAIYNAIVKVVVANIGYEGQYHVRIVNQDIKTKDDDTSQNNTIEPLNVQTGQEDKVTATDTAENSSTATNPKDASDKADVIEPESDVVKDADSSVDKDVQNDVDHLSDMSDNTHLDKYDFKEMDTQIAKDTDKGVDNSLGMTSNVDTDKDSNKNEGKVIQLAHNTDKNHTGKAAKLDGVRQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 36351 - protein, 2189 aa, Staphylococcus aureus
  subsp. aureus C427
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMVDEDATLNDIKKHTQFIIDEILAIKLPAEVIKASPKVGQPAPKVCTPIKKEDKQEVRKVVKELPNTGSEEMDLPLKELALITGAALLARRRSKKEKES

SEQ ID NO: 36352 - protein, 331 aa, Staphylococcus aureus; identical to SEQ ID NO: 31235
  subsp. aureus C427

SEQ ID NO: 36353 - protein, 672 aa, Staphylococcus aureus
  subsp. aureus C427
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAEAMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKMTKKMSIMK

SEQ ID NO: 36354 - protein, 258 aa, Staphylococcus aureus
  subsp. aureus C427
MKKLSTVIIILILEIVFHNINYANSQPDPKIDELNKVSDYKSNNGTMGNVMNLYMSPPVEGRGVINSRQFLSHDLIFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 36355 - protein, 251 aa, Staphylococcus aureus; identical to SEQ ID NO: 30505
  subsp. aureus C427

SEQ ID NO: 36356 - protein, 261 aa, Staphylococcus aureus; identical to SEQ ID NO: 30506
  subsp. aureus C427

SEQ ID NO: 36357 - protein, 242 aa, Staphylococcus aureus; identical to SEQ ID NO: 30522
  subsp. aureus C427

SEQ ID NO: 36358 - protein, 239 aa, Staphylococcus aureus
  subsp. aureus C427
MKRILIIVVLLFCYSQNRIATADVGVLNLRNYYGSYPIEDHQNINPDNNRLSHQLVFSKDNSTVTAEFKNVEDVKKFKNRAVDVYGLSYSGYCLKNKYMYGGVTLAGDYLEKSRCIPINLWVNGNLKTISTDKVSTNKKIVTAQEIDTKLRRYLQEEYNIYGFNDTNKGRNYGTKSKFFSGFNTGKISFHLNDGTSFSYDLFDTGTGQAESFLKIYNDNKTVETDKFHLDVEISYKDES

SEQ ID NO: 36359 - protein, 254 aa, Staphylococcus aureus; identical to SEQ ID NO: 31226
  subsp. aureus C427

SEQ ID NO: 36360 - protein, 689 aa, Staphylococcus aureus
  subsp. aureus C427
MKFKSLITTTLALGVLASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKANNQVPYSINLNGTTTNIQSNLAFSNKPWTNYKNLTAKVKSVLKSDRGVSERDLKHAKKAYYTVYFKNGGKRVIHLNSNIYTANLVHAKDIKKIEVTVKTGSKANAERYVPYTIAVNGTSTPNLSDLKFKGDSRVSYSDITKKVKSVLKYDRGIGERELKYAKKATYTVNFKNGTKKVINLNSKISQLNLLFVKDIKKIDVDVKTGSKAKADSYVPYTIAVNGTSTPIASKLKLSNKQLIGYQDLNKKVKSVLKHDRGINDIELKFAKQAKYTVHFKNGKTQVVDLKSDIFTRNLFSVKDIKKIDIDVKQHTKSNKALNKVANIATKVKFPVTINGFSNVVSNEFAFLHPHKITTNDLNAKLRLALASDQGITKHDIGLSERTVYKVYFKDGSSKFVDLKAAKQDSKVFKATDIKKVDIEIKF

SEQ ID NO: 36361 - protein, 274 aa, Staphylococcus aureus; identical to SEQ ID NO: 33993
  subsp. aureus C427

SEQ ID NO: 36362 - protein, 339 aa, Staphylococcus aureus; identical to SEQ ID NO: 31219
  subsp. aureus C427

SEQ ID NO: 36363 - protein, 351 aa, Staphylococcus aureus; identical to SEQ ID NO: 33991
  subsp. aureus C427

SEQ ID NO: 36364 - protein, 234 aa, Staphylococcus aureus; identical to SEQ ID NO: 30395
  subsp. aureus C427

SEQ ID NO: 36365 - protein, 231 aa, Staphylococcus aureus; identical to SEQ ID NO: 31216
  subsp. aureus C427

SEQ ID NO: 36366 - protein, 808 aa, Staphylococcus aureus; identical to SEQ ID NO: 31215
  subsp. aureus C427

SEQ ID NO: 36367 - protein, 141 aa, Staphylococcus aureus; identical to SEQ ID NO: 31214
  subsp. aureus C427

SEQ ID NO: 36368 - protein, 321 aa, Staphylococcus aureus; identical to SEQ ID NO: 31900
  subsp. aureus C427

SEQ ID NO: 36369 - protein, 315 aa, Staphylococcus aureus; identical to SEQ ID NO: 31191
  subsp. aureus C427

SEQ ID NO: 36370 - protein, 325 aa, Staphylococcus aureus; identical to SEQ ID NO: 30479
  subsp. aureus C427

SEQ ID NO: 36371 - protein, 1033 aa, Staphylococcus aureus
  subsp. aureus C427
MIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGVVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPEVPSEPETPTPPTPEVPSEPETPTPPTPEVPSEPETPTPPTPEVPSEPETPTPPTPEVPSEPETPTPPTPEVPSEPGTPVPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 36372 - protein, 233 aa, Staphylococcus aureus; identical to SEQ ID NO: 31039
  subsp. aureus C427

SEQ ID NO: 36373 - protein, 852 aa, Staphylococcus aureus
  subsp. aureus C427
MSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSEPSVRTRAVRSLAVAEPVVNAADAKGTNVNDKVTASDFKLEKTTFDPNQSGNTFMAANFKVAGKVKSGDYFTAKLPDSVTGNGDVDYSNSNNTMPIADIVNDKKEVVAKATYDILTKTYTFVFTDYVNDKENINGQFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPEPTPDPEPSPDPDPEPTPDPEPSPEPDPDSDSDSDSGSDSDSDSDSDSESDSDSDSDSDSDSDSDSDSDSDSESDSDSDSDSDSDSDSDSDSDSDSNSDSESDSDSDSDSDSDSESDSESDSDSDSESDSDSDSDSESDSDSDSDSDSDSDSDSESDSDSDSDSDSDSDSDSDSDSDSESDSDSDSDSDSDSDSDSDSDSDSESDSDSDSDSRVTPPNNEQKAPSNPKGEVNHSNKASKQHQTDALPETGDKSENTNATLFGAMMALLGSLLLFRKRKQDHKEKA

SEQ ID NO: 36374 - protein, 111 aa, Staphylococcus aureus; identical to SEQ ID NO: 36278
  subsp. aureus C427

SEQ ID NO: 36375 - protein, 681 aa, Staphylococcus aureus; identical to SEQ ID NO: 35560
  subsp. aureus C427

SEQ ID NO: 36376 - protein, 240 aa, Staphylococcus aureus
  subsp. aureus C427
MINKIKILFSFLALLLSFTSYAKAEDLHDKSELTDLALANAYGQYNHPFIKENIKSDEISGEKDLIFRNQGDSGNDLRVKFATADLAQKFKNKSVDIYGASFYYKCEKISENISECLYGGTTLNSEKLAQERVIGANVWVDGIQKETELIRTNKKNVTLQELDIKIRKILSDKYKIYYKDSEISKGLIEFDMKTPRDYSFDIYDLKGENDYEIDKIYEDNKTLKSDDISHIDVNLYTKKV

SEQ ID NO: 36377 - protein, 110 aa, Staphylococcus aureus; identical to SEQ ID NO: 36281
  subsp. aureus C427

SEQ ID NO: 36378 - protein, 534 aa, Staphylococcus aureus; identical to SEQ ID NO: 36282
  subsp. aureus C427

SEQ ID NO: 36379 - protein, 221 aa, Staphylococcus aureus; identical to SEQ ID NO: 31036
  subsp. aureus C427

SEQ ID NO: 36380 - protein, 691 aa, Staphylococcus aureus
  subsp. aureus C427
MLRGQEERKYSIRKYSIGVVSVLAATMFVVTSHEAQASEKIPTTNAAAQKETLNQPGEQGNAITSHQMQSGKQLDDMHKENGKSGTVTEGKDMLQSPKHQSTQNSKIIRTQNDNQVKQDSERQGSKQSHQNNATNKTERQNDQIQNTHHAERNGSQSTTSQSNDVDKSQPSIPAQKVIPNHDKAAPTSTTPPSNDKTAPKSTKEQDATTDKHPNQQDTHQPAHQIIDAKQDDNVHQSNQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKYKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLNGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 36381 - protein, 291 aa, Staphylococcus aureus; identical to SEQ ID NO: 30390
  subsp. aureus CGS00

SEQ ID NO: 36382 - protein, 278 aa, Staphylococcus aureus; identical to SEQ ID NO: 34714
  subsp. aureus CGS00

SEQ ID NO: 36383 - protein, 2189 aa, Staphylococcus aureus
  subsp. aureus CGS00
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRENDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMVDEDATLNDIKKDTQLIIDEILAIKLPAEVIKASPKVGQPAPKVCTPIKKEDKQEVRKVVKELPNTGSEEMDLPLKELALITGAALLARRRSKKEKES

SEQ ID NO: 36384 - protein, 331 aa, Staphylococcus aureus; identical to SEQ ID NO: 31235
  subsp. aureus CGS00

SEQ ID NO: 36385 - protein, 806 aa, Staphylococcus aureus
  subsp. aureus CGS00
MTNKMKKWQKLSTITLLMTGVVALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 36386 - protein, 258 aa, Staphylococcus aureus; identical to SEQ ID NO: 30518
  subsp. aureus CGS00

SEQ ID NO: 36387 - protein, 249 aa, Staphylococcus aureus
  subsp. aureus CGS00
MFCIAAIIITLLCLINNNYVNADVDKNDLKKKSDIDSSKLFNLTSYYTDITWQLDESNKISTDQLLNNTIILKDIDISVLKTSSLKVEFNSSDLANQFKGKNIDIYGLYYGNKCVGLTEEKTSCLYGGVTIYDGNQLDEERVIGVNVFKDGIQQEGFVIKTKKAKVTVQELDTKVRFKLENLYKIYNKDTGNIQKGCIFFHSNNHQNQSFYYDLYNIKGSVGAEFFQFYSDNRTVSSSNYHIDVFLYKD

SEQ ID NO: 36388 - protein, 261 aa, Staphylococcus aureus; identical to SEQ ID NO: 30506
  subsp. aureus CGS00

SEQ ID NO: 36389 - protein, 242 aa, Staphylococcus aureus; identical to SEQ ID NO: 30522
  subsp. aureus CGS00

SEQ ID NO: 36390 - protein, 239 aa, Staphylococcus aureus; identical to SEQ ID NO: 30171
  subsp. aureus CGS00

SEQ ID NO: 36391 - protein, 254 aa, Staphylococcus aureus; identical to SEQ ID NO: 31226
  subsp. aureus CGS00

SEQ ID NO: 36392 - protein, 233 aa, Staphylococcus aureus; identical to SEQ ID NO: 31039
  subsp. aureus CGS00

SEQ ID NO: 36393 - protein, 819 aa, Staphylococcus aureus
  subsp. aureus CGS00
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSDSDSDSDSDSDSDSDSDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKRHHQILKVK

SEQ ID NO: 36394 - protein, 809 aa, Staphylococcus aureus
  subsp. aureus CGS00
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 36395 - protein, 1351 aa, Staphylococcus aureus; identical to SEQ ID NO: 31203
  subsp. aureus CGS00

SEQ ID NO: 36396 - protein, 680 aa, Staphylococcus aureus; identical to SEQ ID NO: 31201
  subsp. aureus CGS00

SEQ ID NO: 36397 - protein, 965 aa, Staphylococcus aureus
  subsp. aureus CGS00
MKNNLRYGIRKHKLGAASVFLGTMIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQAKKSELPETGGEESTNKGMLFGGLFSILGLALLRRNKKNHKA

SEQ ID NO: 36398 - protein, 309 aa, Staphylococcus aureus; identical to SEQ ID NO: 33946
  subsp. aureus CGS00

SEQ ID NO: 36399 - protein, 315 aa, Staphylococcus aureus; identical to SEQ ID NO: 31191
  subsp. aureus CGS00

SEQ ID NO: 36400 - protein, 325 aa, Staphylococcus aureus; identical to SEQ ID NO: 30479
  subsp. aureus CGS00

SEQ ID NO: 36401 - protein, 508 aa, Staphylococcus aureus
  subsp. aureus CGS00
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 36402 - protein, 221 aa, Staphylococcus aureus; identical to SEQ ID NO: 31036
  subsp. aureus CGS00

SEQ ID NO: 36403 - protein, 691 aa, Staphylococcus aureus; identical to SEQ ID NO: 31040
  subsp. aureus CGS00

SEQ ID NO: 36404 - protein, 1023 aa, Staphylococcus aureus
  subsp. aureus CGS00
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDADSDSDSDSDSDTESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 36405 - protein, 434 aa, Staphylococcus aureus [sequence omitted]

SEQ ID NO: 36406 - protein, 238 aa, Staphylococcus aureus; identical to SEQ ID NO: 31240
  subsp. aureus CGS00

SEQ ID NO: 36407 - protein, 241 aa, Staphylococcus aureus; identical to SEQ ID NO: 31239
  subsp. aureus CGS00

SEQ ID NO: 36408 - protein, 241 aa, Staphylococcus aureus; identical to SEQ ID NO: 31173
  subsp. aureus CGS00

SEQ ID NO: 36409 - protein, 786 aa, Staphylococcus aureus
  subsp. aureus CGS00
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDTDSDSDSDSDSDCDSDSDSDSDSDSDFRFR

SEQ ID NO: 36410 - protein, 54 aa, Staphylococcus aureus; identical to SEQ ID NO: 35777
  subsp. aureus CGS00

SEQ ID NO: 36411 - protein, 884 aa, Staphylococcus aureus
  subsp. aureus CGS00
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGK

SEQ ID NO: 36412 - protein, 652 aa, Staphylococcus aureus; identical to SEQ ID NO: 34746
  subsp. aureus CGS00

SEQ ID NO: 36413 - protein, 354 aa, Staphylococcus aureus; identical to SEQ ID NO: 30412
  subsp. aureus CGS00

SEQ ID NO: 36414 - protein, 105 aa, Staphylococcus aureus; identical to SEQ ID NO: 31168
  subsp. aureus CGS00

SEQ ID NO: 36415 - protein, 165 aa, Staphylococcus aureus; identical to SEQ ID NO: 31241
  subsp. aureus CGS00

SEQ ID NO: 36416 - protein, 206 aa, Staphylococcus aureus; identical to SEQ ID NO: 34750
  subsp. aureus CGS00

SEQ ID NO: 36417 - protein, 112 aa, Staphylococcus aureus; identical to SEQ ID NO: 34751
  subsp. aureus CGS00

SEQ ID NO: 36418 - protein, 231 aa, Staphylococcus aureus
  subsp. aureus CGS00
MKKTLLASSLAVGLGIVAGNAGHEAQASEADLNKASLAQMAQSNDQTLNQKPIEAGAYNYIFDYEGFTYHFESDGTHFAWNYHATGANGADMSAQAPATNNVAPSADQSNQVQSQEVEAPQNAQTQQPQASTSNNSQVTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 36419 - protein, 226 aa, Staphylococcus aureus; identical to SEQ ID NO: 31265
  subsp. aureus CGS00

SEQ ID NO: 36420 - protein, 233 aa, Staphylococcus aureus; identical to SEQ ID NO: 31264
  subsp. aureus CGS00

SEQ ID NO: 36421 - protein, 343 aa, Staphylococcus aureus; identical to SEQ ID NO: 31263
  subsp. aureus CGS00

SEQ ID NO: 36422 - protein, 325 aa, Staphylococcus aureus; identical to SEQ ID NO: 33964
  subsp. aureus CGS00

SEQ ID NO: 36423 - protein, 234 aa, Staphylococcus aureus; identical to SEQ ID NO: 30567
  subsp. aureus CGS00

SEQ ID NO: 36424 - protein, 231 aa, Staphylococcus aureus; identical to SEQ ID NO: 30566
  subsp. aureus CGS00

SEQ ID NO: 36425 - protein, 232 aa, Staphylococcus aureus; identical to SEQ ID NO: 30565
  subsp. aureus CGS00

SEQ ID NO: 36426 - protein, 227 aa, Staphylococcus aureus; identical to SEQ ID NO: 30564
  subsp. aureus CGS00

SEQ ID NO: 36427 - protein, 232 aa, Staphylococcus aureus; identical to SEQ ID NO: 31257
  subsp. aureus CGS00

SEQ ID NO: 36428 - protein, 808 aa, Staphylococcus aureus; identical to SEQ ID NO: 31215
  subsp. aureus CGS00

SEQ ID NO: 36429 - protein, 141 aa, Staphylococcus aureus; identical to SEQ ID NO: 31214
  subsp. aureus CGS00

SEQ ID NO: 36430 - protein, 689 aa, Staphylococcus aureus; identical to SEQ ID NO: 31861
  subsp. aureus CGS00

SEQ ID NO: 36431 - protein, 339 aa, Staphylococcus aureus; identical to SEQ ID NO: 31219
  subsp. aureus CGS00

SEQ ID NO: 36432 - protein, 351 aa, Staphylococcus aureus; identical to SEQ ID NO: 31218
  subsp. aureus CGS00

SEQ ID NO: 36433 - protein, 234 aa, Staphylococcus aureus; identical to SEQ ID NO: 30530
  subsp. aureus CGS00

SEQ ID NO: 36434 - protein, 86 aa, Staphylococcus aureus
  subsp. aureus CGS00
SDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 36435 - protein, 1015 aa, Staphylococcus aureus
  subsp. aureus CGS00
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKDGKQDSSEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTK

SEQ ID NO: 36436 - protein, 291 aa, Staphylococcus aureus; identical to SEQ ID NO: 30390
  subsp. aureus CGS01

SEQ ID NO: 36437 - protein, 234 aa, Staphylococcus aureus; identical to SEQ ID NO: 30736
  subsp. aureus CGS01

SEQ ID NO: 36438 - protein, 372 aa, Staphylococcus aureus; identical to SEQ ID NO: 31084
  subsp. aureus CGS01

SEQ ID NO: 36439 - protein, 141 aa, Staphylococcus aureus; identical to SEQ ID NO: 30715
  subsp. aureus CGS01

SEQ ID NO: 36440 - protein, 807 aa, Staphylococcus aureus; identical to SEQ ID NO: 30716
  subsp. aureus CGS01

SEQ ID NO: 36441 - protein, 690 aa, Staphylococcus aureus
  subsp. aureus CGS01
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRMQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEGFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 36442 - protein, 203 aa, Staphylococcus aureus; identical to SEQ ID NO: 30770
  subsp. aureus CGS01

SEQ ID NO: 36443 - protein, 226 aa, Staphylococcus aureus; identical to SEQ ID NO: 30769
  subsp. aureus CGS01

SEQ ID NO: 36444 - protein, 231 aa, Staphylococcus aureus; identical to SEQ ID NO: 30768
  subsp. aureus CGS01

SEQ ID NO: 36445 - protein, 352 aa, Staphylococcus aureus; identical to SEQ ID NO: 30767
  subsp. aureus CGS01

SEQ ID NO: 36446 - protein, 308 aa, Staphylococcus aureus
  subsp. aureus CGS01
MKITTIAKTSLALGLLTTGVITTTTQAANATTPSSTKVEAPQSTPPSTKIEAPQSKPNATTPPSTKVEAPQQTANATTPPSTKVTTPPSTNTSQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 36447 - protein, 234 aa, Staphylococcus aureus; identical to SEQ ID NO: 31052
  subsp. aureus CGS01

SEQ ID NO: 36448 - protein, 231 aa, Staphylococcus aureus; identical to SEQ ID NO: 31761
  subsp. aureus CGS01

SEQ ID NO: 36449 - protein, 231 aa, Staphylococcus aureus; identical to SEQ ID NO: 30560
  subsp. aureus CGS01

SEQ ID NO: 36450 - protein, 232 aa, Staphylococcus aureus; identical to SEQ ID NO: 31054
  subsp. aureus CGS01

SEQ ID NO: 36451 - protein, 232 aa, Staphylococcus aureus; identical to SEQ ID NO: 30765
  subsp. aureus CGS01

SEQ ID NO: 36452 - protein, 227 aa, Staphylococcus aureus; identical to SEQ ID NO: 30585
  subsp. aureus CGS01

SEQ ID NO: 36453 - protein, 674 aa, Staphylococcus aureus
  subsp. aureus CGS01
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDS

SEQ ID NO: 36454 - protein, 2271 aa, Staphylococcus aureus; identical to SEQ ID NO: 32024
  subsp. aureus CGS01

SEQ ID NO: 36455 - protein, 680 aa, Staphylococcus aureus; identical to SEQ ID NO: 30700
  subsp. aureus CGS01

SEQ ID NO: 36456 - protein, 312 aa, Staphylococcus aureus; identical to SEQ ID NO: 30196
  subsp. aureus CGS01

SEQ ID NO: 36457 - protein, 325 aa, Staphylococcus aureus; identical to SEQ ID NO: 30484
  subsp. aureus CGS01

SEQ ID NO: 36458 - protein, 325 aa, Staphylococcus aureus; identical to SEQ ID NO: 30407
  subsp. aureus CGS01

SEQ ID NO: 36459 - protein, 315 aa, Staphylococcus aureus; identical to SEQ ID NO: 30440
  subsp. aureus CGS01

SEQ ID NO: 36460 - protein, 321 aa, Staphylococcus aureus; identical to SEQ ID NO: 30959
  subsp. aureus CGS01

SEQ ID NO: 36461 - protein, 242 aa, Staphylococcus aureus; identical to SEQ ID NO: 31991
  subsp. aureus CGS01

SEQ ID NO: 36462 - protein, 242 aa, Staphylococcus aureus; identical to SEQ ID NO: 31992
  subsp. aureus CGS01

SEQ ID NO: 36463 - protein, 895 aa, Staphylococcus aureus; identical to SEQ ID NO: 30734
  subsp. aureus CGS01

SEQ ID NO: 36464 - protein, 2186 aa, Staphylococcus aureus; identical to SEQ ID NO: 31059
  subsp. aureus CGS01

SEQ ID NO: 36465 - protein, 435 aa, Staphylococcus aureus
  subsp. aureus CGS01
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKLKRFHS

SEQ ID NO: 36466 - protein, 940 aa, Staphylococcus aureus; identical to SEQ ID NO: 30465
  subsp. aureus CGS01

SEQ ID NO: 36467 - protein, 1018 aa, Staphylococcus aureus; identical to SEQ ID NO: 30707
  subsp. aureus CGS01

SEQ ID NO: 36468 - protein, 233 aa, Staphylococcus aureus; identical to SEQ ID NO: 30428
  subsp. aureus CGS01

SEQ ID NO: 36469 - protein, 231 aa, Staphylococcus aureus; identical to SEQ ID NO: 31073
  subsp. aureus CGS01

SEQ ID NO: 36470 - protein, 645 aa, Staphylococcus aureus; identical to SEQ ID NO: 30747
  subsp. aureus CGS01

SEQ ID NO: 36471 - protein, 350 aa, Staphylococcus aureus; identical to SEQ ID NO: 30602
  subsp. aureus CGS01

SEQ ID NO: 36472 - protein, 109 aa, Staphylococcus aureus; identical to SEQ ID NO: 30744
  subsp. aureus CGS01

SEQ ID NO: 36473 - protein, 165 aa, Staphylococcus aureus; identical to SEQ ID NO: 30742
  subsp. aureus CGS01

SEQ ID NO: 36474 - protein, 319 aa, Staphylococcus aureus; identical to SEQ ID NO: 30741
  subsp. aureus CGS01

SEQ ID NO: 36475 - protein, 238 aa, Staphylococcus aureus; identical to SEQ ID NO: 30740
  subsp. aureus CGS01

SEQ ID NO: 36476 - protein, 241 aa, Staphylococcus aureus; identical to SEQ ID NO: 30739
  subsp. aureus CGS01

SEQ ID NO: 36477 - protein, 241 aa, Staphylococcus aureus; identical to SEQ ID NO: 30738
  subsp. aureus CGS01

SEQ ID NO: 36478 - protein, 311 aa, Staphylococcus aureus; identical to SEQ ID NO: 30617
  subsp. aureus CGS01

SEQ ID NO: 36479 - protein, 327 aa, Staphylococcus aureus; identical to SEQ ID NO: 30538
  subsp. aureus CGS01

SEQ ID NO: 36480 - protein, 351 aa, Staphylococcus aureus; identical to SEQ ID NO: 30720
  subsp. aureus CGS01

SEQ ID NO: 36481 - protein, 338 aa, Staphylococcus aureus; identical to SEQ ID NO: 30699
  subsp. aureus CGS01

SEQ ID NO: 36482 - protein, 274 aa, Staphylococcus aureus; identical to SEQ ID NO: 30872
  subsp. aureus CGS01

SEQ ID NO: 36483 - protein, 225 aa, Staphylococcus aureus; identical to SEQ ID NO: 30763
  subsp. aureus CGS01

SEQ ID NO: 36484 - protein, 783 aa, Staphylococcus aureus
  subsp. aureus CGS01
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDIFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSD

SEQ ID NO: 36485 - protein, 96 aa, Staphylococcus aureus; identical to SEQ ID NO: 30813
  subsp. aureus CGS01

SEQ ID NO: 36486 - protein, 110 aa, Staphylococcus aureus
  subsp. aureus CGS01
SDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 36487 - protein, 241 aa, Staphylococcus aureus; identical to SEQ ID NO: 30776
  subsp. aureus CGS01

SEQ ID NO: 36488 - protein, 508 aa, Staphylococcus aureus; identical to SEQ ID NO: 30777
  subsp. aureus CGS01

SEQ ID NO: 36489 - protein, 241 aa, Staphylococcus aureus; identical to SEQ ID NO: 32458
  subsp. aureus CGS01

SEQ ID NO: 36490 - protein, 434 aa, Staphylococcus aureus [sequence omitted]

SEQ ID NO: 36491 - protein, 933 aa, Staphylococcus aureus; identical to SEQ ID NO: 30755
  subsp. aureus CGS01

SEQ ID NO: 36492 - protein, 1102 aa, Staphylococcus aureus; identical to SEQ ID NO: 32042
  subsp. aureus CGS01

SEQ ID NO: 36493 - protein, 331 aa, Staphylococcus aureus; identical to SEQ ID NO: 30732
  subsp. aureus CGS01

SEQ ID NO: 36494 - protein, 134 aa, Staphylococcus aureus; identical to SEQ ID NO: 34301
  subsp. aureus CGS01

SEQ ID NO: 36495 - protein, 1167 aa, Staphylococcus aureus
  subsp. aureus CGS01
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNETYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSD

SEQ ID NO: 36496 - protein, 108 aa, Staphylococcus aureus
  subsp. aureus CGS01
SDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 36497 - protein, 965 aa, Staphylococcus aureus
  subsp. aureus CGS01
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDS

SEQ ID NO: 36498 - protein, 134 aa, Staphylococcus aureus
  subsp. aureus CGS01
SDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 36499 - protein, 319 aa, Staphylococcus aureus; identical to SEQ ID NO: 30605
  subsp. aureus CGS03

SEQ ID NO: 36500 - protein, 238 aa, Staphylococcus aureus; identical to SEQ ID NO: 30606
  subsp. aureus CGS03

SEQ ID NO: 36501 - protein, 241 aa, Staphylococcus aureus; identical to SEQ ID NO: 30607
  subsp. aureus CGS03

SEQ ID NO: 36502 - protein, 241 aa, Staphylococcus aureus; identical to SEQ ID NO: 30608
  subsp. aureus CGS03

SEQ ID NO: 36503 - protein, 372 aa, Staphylococcus aureus; identical to SEQ ID NO: 30609
  subsp. aureus CGS03

SEQ ID NO: 36504 - protein, 211 aa, Staphylococcus aureus; identical to SEQ ID NO: 30592
  subsp. aureus CGS03

SEQ ID NO: 36505 - protein, 233 aa, Staphylococcus aureus; identical to SEQ ID NO: 30591
  subsp. aureus CGS03

SEQ ID NO: 36506 - protein, 1038 aa, Staphylococcus aureus; identical to SEQ ID NO: 30590
  subsp. aureus CGS03

SEQ ID NO: 36507 - protein, 961 aa, Staphylococcus aureus; identical to SEQ ID NO: 30589
  subsp. aureus CGS03

SEQ ID NO: 36508 - protein, 930 aa, Staphylococcus aureus
  subsp. aureus CGS03
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 36509 - protein, 325 aa, Staphylococcus aureus; identical to SEQ ID NO: 30407
  subsp. aureus CGS03

SEQ ID NO: 36510 - protein, 203 aa, Staphylococcus aureus
  subsp. aureus CGS03
LKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 36511 - protein, 254 aa, Staphylococcus aureus; identical to SEQ ID NO: 30809
  subsp. aureus CGS03

SEQ ID NO: 36512 - protein, 239 aa, Staphylococcus aureus; identical to SEQ ID NO: 30622
  subsp. aureus CGS03

SEQ ID NO: 36513 - protein, 242 aa, Staphylococcus aureus; identical to SEQ ID NO: 30399
  subsp. aureus CGS03

SEQ ID NO: 36514 - protein, 131 aa, Staphylococcus aureus; identical to SEQ ID NO: 30867
  subsp. aureus CGS03

SEQ ID NO: 36515 - protein, 249 aa, Staphylococcus aureus
  subsp. aureus CGS03
MFYIAAIIITLLCLINNNYVNAEVDKKDLKKKSDLDSSKLFNLTSYYTDITWQLDESNKISTDQLLNNTIILKNIDISVLKTSSLKVEFNSSDLANQFKGKNIDIYGLYFGNKCVGLTEEKTSCLYGGVTIHDGNQLDEEKVIGVNVFKDGVQQEGFVIKTKKAKVTVQELDTKVRFKLENLYKIYNKDTGNIQKGCIFFHSHNHQDQSFYYDLYNVKGSVGAEFFQFYSDNRTVSSSNYHIDVFLYKD

SEQ ID NO: 36516 - protein, 258 aa, Staphylococcus aureus; identical to SEQ ID NO: 30410
  subsp. aureus CGS03

SEQ ID NO: 36517 - protein, 311 aa, Staphylococcus aureus; identical to SEQ ID NO: 30617
  subsp. aureus CGS03

SEQ ID NO: 36518 - protein, 327 aa, Staphylococcus aureus; identical to SEQ ID NO: 30616
  subsp. aureus CGS03

SEQ ID NO: 36519 - protein, 331 aa, Staphylococcus aureus; identical to SEQ ID NO: 30615
  subsp. aureus CGS03

SEQ ID NO: 36520 - protein, 2186 aa, Staphylococcus aureus; identical to SEQ ID NO: 30789
  subsp. aureus CGS03

SEQ ID NO: 36521 - protein, 891 aa, Staphylococcus aureus; identical to SEQ ID NO: 30788
  subsp. aureus CGS03

SEQ ID NO: 36522 - protein, 691 aa, Staphylococcus aureus; identical to SEQ ID NO: 30511
  subsp. aureus CGS03

SEQ ID NO: 36523 - protein, 203 aa, Staphylococcus aureus; identical to SEQ ID NO: 30576
  subsp. aureus CGS03

SEQ ID NO: 36524 - protein, 226 aa, Staphylococcus aureus; identical to SEQ ID NO: 30577
  subsp. aureus CGS03

SEQ ID NO: 36525 - protein, 231 aa, Staphylococcus aureus; identical to SEQ ID NO: 30578
  subsp. aureus CGS03

SEQ ID NO: 36526 - protein, 356 aa, Staphylococcus aureus; identical to SEQ ID NO: 30579
  subsp. aureus CGS03

SEQ ID NO: 36527 - protein, 263 aa, Staphylococcus aureus
  subsp. aureus CGS03
MKITTIAKTSLALGLLTTGVITTTTQEANATTPSSTKVETPQQTPNATTPSSTKVETPQSPTTKQVPTEINPKFKDLRAYYTKPSLEFKNEIGIILKKWTTIRFMNIVPDYFIYKIALVGKDDKKYDEGVHRNVDVFVVLEEKNKYGVERYSVGGITKSNSKKVDHKAGVRITKEDNKGTISHDVSEFKITKEQISLKELDFKLRKQLIENHNLYGNVGSGKIVINMKNGGKYTFELHKKLQENRMADVIDGTNIDNIEVNIK

SEQ ID NO: 36528 - protein, 234 aa, Staphylococcus aureus; identical to SEQ ID NO: 30581
  subsp. aureus CGS03

SEQ ID NO: 36529 - protein, 231 aa, Staphylococcus aureus; identical to SEQ ID NO: 30582
  subsp. aureus CGS03

SEQ ID NO: 36530 - protein, 232 aa, Staphylococcus aureus; identical to SEQ ID NO: 30583
  subsp. aureus CGS03

SEQ ID NO: 36531 - protein, 232 aa, Staphylococcus aureus; identical to SEQ ID NO: 30584
  subsp. aureus CGS03

SEQ ID NO: 36532 - protein, 227 aa, Staphylococcus aureus; identical to SEQ ID NO: 30585
  subsp. aureus CGS03

SEQ ID NO: 36533 - protein, 227 aa, Staphylococcus aureus; identical to SEQ ID NO: 30586
  subsp. aureus CGS03

SEQ ID NO: 36534 - protein, 62 aa, Staphylococcus aureus; identical to SEQ ID NO: 30610
  subsp. aureus CGS03

SEQ ID NO: 36535 - protein, 157 aa, Staphylococcus aureus; identical to SEQ ID NO: 30611
  subsp. aureus CGS03

SEQ ID NO: 36536 - protein, 291 aa, Staphylococcus aureus; identical to SEQ ID NO: 30390
  subsp. aureus CGS03

SEQ ID NO: 36537 - protein, 141 aa, Staphylococcus aureus; identical to SEQ ID NO: 30633
  subsp. aureus CGS03

SEQ ID NO: 36538 - protein, 809 aa, Staphylococcus aureus; identical to SEQ ID NO: 30632
  subsp. aureus CGS03

SEQ ID NO: 36539 - protein, 859 aa, Staphylococcus aureus
  subsp. aureus CGS03
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSESDSDSDSDSDSDSDSDSESDSDSESDSESDSDSDSDSDSDSDSDSDSDSDSDSDSDSDSDSDSDSESDSDSDSDSDSESDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 36540 - protein, 2271 aa, Staphylococcus aureus; identical to SEQ ID NO: 30597
  subsp. aureus CGS03

SEQ ID NO: 36541 - protein, 680 aa, Staphylococcus aureus; identical to SEQ ID NO: 30845
  subsp. aureus CGS03

SEQ ID NO: 36542 - protein, 96 aa, Staphylococcus aureus; identical to SEQ ID NO: 30813
  subsp. aureus CGS03

SEQ ID NO: 36543 - protein, 508 aa, Staphylococcus aureus; identical to SEQ ID NO: 30782
  subsp. aureus CGS03

SEQ ID NO: 36544 - protein, 241 aa, Staphylococcus aureus; identical to SEQ ID NO: 30571
  subsp. aureus CGS03

SEQ ID NO: 36545 - protein, 767 aa, Staphylococcus aureus
  subsp. aureus CGS03
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSNSDSESGSNNNVVPPNSPKNGTNASNKNEAKDSKEPLPDTGSEDEANTSLIWGLLASLGSLLLFRRKKENKDKK

SEQ ID NO: 36546 - protein, 434 aa, Staphylococcus aureus [sequence omitted]

SEQ ID NO: 36547 - protein, 133 aa, Staphylococcus aureus
  subsp. aureus CGS03
  MOD_RES (2)..(3): Any amino acid
IXXSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 36548 - protein, 965 aa, Staphylococcus aureus; identical to SEQ ID NO: 30920
  subsp. aureus CGS03

SEQ ID NO: 36549 - protein, 1142 aa, Staphylococcus aureus
  subsp. aureus CGS03
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDIANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDS

SEQ ID NO: 36550 - protein, 231 aa, Staphylococcus aureus; identical to SEQ ID NO: 30630
  subsp. aureus CGS03

SEQ ID NO: 36551 - protein, 351 aa, Staphylococcus aureus; identical to SEQ ID NO: 30628
  subsp. aureus CGS03

SEQ ID NO: 36552 - protein, 338 aa, Staphylococcus aureus; identical to SEQ ID NO: 30627
  subsp. aureus CGS03

SEQ ID NO: 36553 - protein, 274 aa, Staphylococcus aureus; identical to SEQ ID NO: 30815
  subsp. aureus CGS03

SEQ ID NO: 36554 - protein, 645 aa, Staphylococcus aureus; identical to SEQ ID NO: 30601
  subsp. aureus CGS03

SEQ ID NO: 36555 - protein, 350 aa, Staphylococcus aureus; identical to SEQ ID NO: 30602
  subsp. aureus CGS03

SEQ ID NO: 36556 - protein, 109 aa, Staphylococcus aureus; identical to SEQ ID NO: 30603
  subsp. aureus CGS03

SEQ ID NO: 36557 - protein, 165 aa, Staphylococcus aureus; identical to SEQ ID NO: 30418
  subsp. aureus CGS03

SEQ ID NO: 36558 - protein, 2481 aa, Staphylococcus aureus; identical to SEQ ID NO: 30631
  subsp. aureus CGS03

SEQ ID NO: 36559 - protein, 978 aa, Staphylococcus aureus
  subsp. aureus CGS03
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDS

SEQ ID NO: 36560 - protein, 153 aa, Staphylococcus aureus
  subsp. aureus CGS03
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 36561 - protein, 321 aa, Staphylococcus aureus; identical to SEQ ID NO: 30959
  subsp. aureus CGS03

SEQ ID NO: 36562 - protein, 112 aa, Staphylococcus aureus
  subsp. aureus CGS03
MLKNKILATTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIG

SEQ ID NO: 36563 - protein, 809 aa, Staphylococcus aureus; identical to SEQ ID NO: 30632
  subsp. aureus CIG1057

SEQ ID NO: 36564 - protein, 141 aa, Staphylococcus aureus; identical to SEQ ID NO: 30633
  subsp. aureus CIG1057

SEQ ID NO: 36565 - protein, 309 aa, Staphylococcus aureus; identical to SEQ ID NO: 30406
  subsp. aureus CIG1057

SEQ ID NO: 36566 - protein, 315 aa, Staphylococcus aureus; identical to SEQ ID NO: 30573
  subsp. aureus CIG1057

SEQ ID NO: 36567 - protein, 325 aa, Staphylococcus aureus
  subsp. aureus CIG1057
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWEKHKVKLLDTKETENNK

SEQ ID NO: 36568 - protein, 859 aa, Staphylococcus aureus
  subsp. aureus CIG1057
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 36569 - protein, 938 aa, Staphylococcus aureus
  subsp. aureus CIG1057
MIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTLPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 36570 - protein, 1015 aa, Staphylococcus aureus
  subsp. aureus CIG1057
MIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERVYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 36571 - protein, 233 aa, Staphylococcus aureus; identical to SEQ ID NO: 30591
  subsp. aureus CIG1057

SEQ ID NO: 36572 - protein, 211 aa, Staphylococcus aureus; identical to SEQ ID NO: 30592
  subsp. aureus CIG1057

SEQ ID NO: 36573 - protein, 877 aa, Staphylococcus aureus; identical to SEQ ID NO: 30593
  subsp. aureus CIG1057

SEQ ID NO: 36574 - protein, 2271 aa, Staphylococcus aureus; identical to SEQ ID NO: 30597
  subsp. aureus CIG1057

SEQ ID NO: 36575 - protein, 681 aa, Staphylococcus aureus; identical to SEQ ID NO: 30598
  subsp. aureus CIG1057

SEQ ID NO: 36576 - protein, 508 aa, Staphylococcus aureus; identical to SEQ ID NO: 30782
  subsp. aureus CIG1057

SEQ ID NO: 36577 - protein, 241 aa, Staphylococcus aureus; identical to SEQ ID NO: 30571
  subsp. aureus CIG1057

SEQ ID NO: 36578 - protein, 691 aa, Staphylococcus aureus; identical to SEQ ID NO: 30511
  subsp. aureus CIG1057

SEQ ID NO: 36579 - protein, 203 aa, Staphylococcus aureus; identical to SEQ ID NO: 30576
  subsp. aureus CIG1057

SEQ ID NO: 36580 - protein, 226 aa, Staphylococcus aureus; identical to SEQ ID NO: 30577
  subsp. aureus CIG1057

SEQ ID NO: 36581 - protein, 231 aa, Staphylococcus aureus; identical to SEQ ID NO: 30578
  subsp. aureus CIG1057

SEQ ID NO: 36582 - protein, 356 aa, Staphylococcus aureus; identical to SEQ ID NO: 30579
  subsp. aureus CIG1057

SEQ ID NO: 36583 - protein, 292 aa, Staphylococcus aureus; identical to SEQ ID NO: 30580
  subsp. aureus CIG1057

SEQ ID NO: 36584 - protein, 234 aa, Staphylococcus aureus; identical to SEQ ID NO: 30581
  subsp. aureus CIG1057

SEQ ID NO: 36585 - protein, 231 aa, Staphylococcus aureus; identical to SEQ ID NO: 30582
  subsp. aureus CIG1057

SEQ ID NO: 36586 - protein, 232 aa, Staphylococcus aureus; identical to SEQ ID NO: 30583
  subsp. aureus CIG1057

SEQ ID NO: 36587 - protein, 232 aa, Staphylococcus aureus; identical to SEQ ID NO: 30584
  subsp. aureus CIG1057

SEQ ID NO: 36588 - protein, 227 aa, Staphylococcus aureus; identical to SEQ ID NO: 30585
  subsp. aureus CIG1057

SEQ ID NO: 36589 - protein, 227 aa, Staphylococcus aureus; identical to SEQ ID NO: 30586
  subsp. aureus CIG1057

SEQ ID NO: 36590 - protein, 965 aa, Staphylococcus aureus; identical to SEQ ID NO: 30920
  subsp. aureus CIG1057

SEQ ID NO: 36591 - protein, 1337 aa, Staphylococcus aureus
  subsp. aureus CIG1057
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNCLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 36592 - protein, 1153 aa, Staphylococcus aureus; identical to SEQ ID NO: 30596
  subsp. aureus CIG1057

SEQ ID NO: 36593 - protein, 434 aa, Staphylococcus aureus [sequence omitted]

SEQ ID NO: 36594 - protein, 905 aa, Staphylococcus aureus; identical to SEQ ID NO: 30600
  subsp. aureus CIG1057

SEQ ID NO: 36595 - protein, 260 aa, Staphylococcus aureus; identical to SEQ ID NO: 30625
  subsp. aureus CIG1057

SEQ ID NO: 36596 - protein, 645 aa, Staphylococcus aureus; identical to SEQ ID NO: 30601
  subsp. aureus CIG1057

SEQ ID NO: 36597 - protein, 350 aa, Staphylococcus aureus; identical to SEQ ID NO: 30602
  subsp. aureus CIG1057

SEQ ID NO: 36598 - protein, 109 aa, Staphylococcus aureus; identical to SEQ ID NO: 30603
  subsp. aureus CIG1057

SEQ ID NO: 36599 - protein, 165 aa, Staphylococcus aureus; identical to SEQ ID NO: 30418
  subsp. aureus CIG1057

SEQ ID NO: 36600 - protein, 319 aa, Staphylococcus aureus; identical to SEQ ID NO: 30605
  subsp. aureus CIG1057

SEQ ID NO: 36601 - protein, 238 aa, Staphylococcus aureus; identical to SEQ ID NO: 30606
  subsp. aureus CIG1057

SEQ ID NO: 36602 - protein, 241 aa, Staphylococcus aureus; identical to SEQ ID NO: 30607
  subsp. aureus CIG1057

SEQ ID NO: 36603 - protein, 241 aa, Staphylococcus aureus; identical to SEQ ID NO: 30608
  subsp. aureus CIG1057

SEQ ID NO: 36604 - protein, 254 aa, Staphylococcus aureus; identical to SEQ ID NO: 30809
  subsp. aureus CIG1057

SEQ ID NO: 36605 - protein, 239 aa, Staphylococcus aureus; identical to SEQ ID NO: 30622
  subsp. aureus CIG1057

SEQ ID NO: 36606 - protein, 242 aa, Staphylococcus aureus; identical to SEQ ID NO: 30399
  subsp. aureus CIG1057

SEQ ID NO: 36607 - protein, 131 aa, Staphylococcus aureus; identical to SEQ ID NO: 30867
  subsp. aureus CIG1057

SEQ ID NO: 36608 - protein, 251 aa, Staphylococcus aureus; identical to SEQ ID NO: 30946
  subsp. aureus CIG1057

SEQ ID NO: 36609 - protein, 258 aa, Staphylococcus aureus; identical to SEQ ID NO: 30410
  subsp. aureus CIG1057

SEQ ID NO: 36610 - protein, 311 aa, Staphylococcus aureus; identical to SEQ ID NO: 30617
  subsp. aureus CIG1057

SEQ ID NO: 36611 - protein, 327 aa, Staphylococcus aureus; identical to SEQ ID NO: 30616
  subsp. aureus CIG1057

SEQ ID NO: 36612 - protein, 331 aa, Staphylococcus aureus; identical to SEQ ID NO: 30615
  subsp. aureus CIG1057

SEQ ID NO: 36613 - protein, 372 aa, Staphylococcus aureus; identical to SEQ ID NO: 30609
  subsp. aureus CIG1057

SEQ ID NO: 36614 - protein, 62 aa, Staphylococcus aureus; identical to SEQ ID NO: 30610
  subsp. aureus CIG1057

SEQ ID NO: 36615 - protein, 138 aa, Staphylococcus aureus; identical to SEQ ID NO: 30785
  subsp. aureus CIG1057

SEQ ID NO: 36616 - protein, 291 aa, Staphylococcus aureus; identical to SEQ ID NO: 30390
  subsp. aureus CIG1057

SEQ ID NO: 36617 - protein, 891 aa, Staphylococcus aureus; identical to SEQ ID NO: 30788
  subsp. aureus CIG1057

SEQ ID NO: 36618 - protein, 2186 aa, Staphylococcus aureus
  subsp. aureus CIG1057
MNLLKKNKYSIRKYKVGIFSTLIGTVLLLSNPNGAQALTTDNNVQSDTNQATPVNSQDTNVANNRGLANSAQNTPNQSATTNQSTNKALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 36619 - protein, 274 aa, Staphylococcus aureus; identical to SEQ ID NO: 30815
  subsp. aureus CIG1057

SEQ ID NO: 36620 - protein, 338 aa, Staphylococcus aureus; identical to SEQ ID NO: 30627
  subsp. aureus CIG1057

SEQ ID NO: 36621 - protein, 351 aa, Staphylococcus aureus
  subsp. aureus CIG1057
MKNKKRVLIASSLSCAILLLSAATTQANSAHKDSQDQNKKKHVDKSQQKDKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 36622 - protein, 44 aa, Staphylococcus aureus; identical to SEQ ID NO: 30513
  subsp. aureus CIG1057

SEQ ID NO: 36623 - protein, 231 aa, Staphylococcus aureus; identical to SEQ ID NO: 30630
  subsp. aureus CIG1057

SEQ ID NO: 36624 - protein, 2481 aa, Staphylococcus aureus; identical to SEQ ID NO: 30631
  subsp. aureus CIG1057

SEQ ID NO: 36625 - protein, 809 aa, Staphylococcus aureus; identical to SEQ ID NO: 30632
  subsp. aureus CIG1096

SEQ ID NO: 36626 - protein, 141 aa, Staphylococcus aureus; identical to SEQ ID NO: 30633
  subsp. aureus CIG1096

SEQ ID NO: 36627 - protein, 309 aa, Staphylococcus aureus; identical to SEQ ID NO: 30406
  subsp. aureus CIG1096

SEQ ID NO: 36628 - protein, 315 aa, Staphylococcus aureus; identical to SEQ ID NO: 30573
  subsp. aureus CIG1096

SEQ ID NO: 36629 - protein, 325 aa, Staphylococcus aureus; identical to SEQ ID NO: 30407
  subsp. aureus CIG1096

SEQ ID NO: 36630 - protein, 859 aa, Staphylococcus aureus
  subsp. aureus CIG1096
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 36631 - protein, 938 aa, Staphylococcus aureus; identical to SEQ ID NO: 30838
  subsp. aureus CIG1096

SEQ ID NO: 36632 - protein, 1015 aa, Staphylococcus aureus; identical to SEQ ID NO: 30839
  subsp. aureus CIG1096

SEQ ID NO: 36633 - protein, 233 aa, Staphylococcus aureus; identical to SEQ ID NO: 30591
  subsp. aureus CIG1096

SEQ ID NO: 36634 - protein, 211 aa, Staphylococcus aureus; identical to SEQ ID NO: 30592
  subsp. aureus CIG1096

SEQ ID NO: 36635 - protein, 877 aa, Staphylococcus aureus; identical to SEQ ID NO: 30593
  subsp. aureus CIG1096

SEQ ID NO: 36636 - protein, 2271 aa, Staphylococcus aureus; identical to SEQ ID NO: 30597
  subsp. aureus CIG1096

SEQ ID NO: 36637 - protein, 681 aa, Staphylococcus aureus; identical to SEQ ID NO: 30598
  subsp. aureus CIG1096

SEQ ID NO: 36638 - protein, 234 aa, Staphylococcus aureus; identical to SEQ ID NO: 30581
  subsp. aureus CIG1096

SEQ ID NO: 36639 - protein, 231 aa, Staphylococcus aureus; identical to SEQ ID NO: 30582
  subsp. aureus CIG1096

SEQ ID NO: 36640 - protein, 232 aa, Staphylococcus aureus; identical to SEQ ID NO: 30583
  subsp. aureus CIG1096

SEQ ID NO: 36641 - protein, 232 aa, Staphylococcus aureus; identical to SEQ ID NO: 30584
  subsp. aureus CIG1096

SEQ ID NO: 36642 - protein, 227 aa, Staphylococcus aureus; identical to SEQ ID NO: 30585
  subsp. aureus CIG1096

SEQ ID NO: 36643 - protein, 227 aa, Staphylococcus aureus; identical to SEQ ID NO: 30586
  subsp. aureus CIG1096

SEQ ID NO: 36644 - protein, 508 aa, Staphylococcus aureus; identical to SEQ ID NO: 30782
  subsp. aureus CIG1096

SEQ ID NO: 36645 - protein, 241 aa, Staphylococcus aureus; identical to SEQ ID NO: 30571
  subsp. aureus CIG1096

SEQ ID NO: 36646 - protein, 691 aa, Staphylococcus aureus; identical to SEQ ID NO: 30511
  subsp. aureus CIG1096

SEQ ID NO: 36647 - protein, 203 aa, Staphylococcus aureus; identical to SEQ ID NO: 30576
  subsp. aureus CIG1096

SEQ ID NO: 36648 - protein, 226 aa, Staphylococcus aureus; identical to SEQ ID NO: 30577
  subsp. aureus CIG1096

SEQ ID NO: 36649 - protein, 231 aa, Staphylococcus aureus; identical to SEQ ID NO: 30578
  subsp. aureus CIG1096

SEQ ID NO: 36650 - protein, 356 aa, Staphylococcus aureus; identical to SEQ ID NO: 30579
  subsp. aureus CIG1096

SEQ ID NO: 36651 - protein, 292 aa, Staphylococcus aureus; identical to SEQ ID NO: 30580
  subsp. aureus CIG1096

SEQ ID NO: 36652 - protein, 291 aa, Staphylococcus aureus; identical to SEQ ID NO: 30390
  subsp. aureus CIG1096

SEQ ID NO: 36653 - protein, 965 aa, Staphylococcus aureus; identical to SEQ ID NO: 30920
  subsp. aureus CIG1096

SEQ ID NO: 36654 - protein, 1337 aa, Staphylococcus aureus; identical to SEQ ID NO: 30811
  subsp. aureus CIG1096

SEQ ID NO: 36655 - protein, 1153 aa, Staphylococcus aureus; identical to SEQ ID NO: 30596
  subsp. aureus CIG1096

SEQ ID NO: 36656 - protein, 434 aa, Staphylococcus aureus [sequence omitted]

SEQ ID NO: 36657 - protein, 905 aa, Staphylococcus aureus; identical to SEQ ID NO: 30600
  subsp. aureus CIG1096

SEQ ID NO: 36658 - protein, 645 aa, Staphylococcus aureus; identical to SEQ ID NO: 30601
  subsp. aureus CIG1096

SEQ ID NO: 36659 - protein, 350 aa, Staphylococcus aureus; identical to SEQ ID NO: 30602
  subsp. aureus CIG1096

SEQ ID NO: 36660 - protein, 109 aa, Staphylococcus aureus; identical to SEQ ID NO: 30603
  subsp. aureus CIG1096

SEQ ID NO: 36661 - protein, 165 aa, Staphylococcus aureus; identical to SEQ ID NO: 30418
  subsp. aureus CIG1096

SEQ ID NO: 36662 - protein, 319 aa, Staphylococcus aureus; identical to SEQ ID NO: 30605
  subsp. aureus CIG1096

SEQ ID NO: 36663 - protein, 238 aa, Staphylococcus aureus; identical to SEQ ID NO: 30606
  subsp. aureus CIG1096

SEQ ID NO: 36664 - protein, 241 aa, Staphylococcus aureus; identical to SEQ ID NO: 30607
  subsp. aureus CIG1096

SEQ ID NO: 36665 - protein, 241 aa, Staphylococcus aureus; identical to SEQ ID NO: 30608
  subsp. aureus CIG1096

SEQ ID NO: 36666 - protein, 372 aa, Staphylococcus aureus; identical to SEQ ID NO: 30609
  subsp. aureus CIG1096

SEQ ID NO: 36667 - protein, 62 aa, Staphylococcus aureus; identical to SEQ ID NO: 30610
  subsp. aureus CIG1096

SEQ ID NO: 36668 - protein, 138 aa, Staphylococcus aureus; identical to SEQ ID NO: 30785
  subsp. aureus CIG1096

SEQ ID NO: 36669 - protein, 891 aa, Staphylococcus aureus; identical to SEQ ID NO: 30788
  subsp. aureus CIG1096

SEQ ID NO: 36670 - protein, 2186 aa, Staphylococcus aureus; identical to SEQ ID NO: 30789
  subsp. aureus CIG1096

SEQ ID NO: 36671 - protein, 331 aa, Staphylococcus aureus; identical to SEQ ID NO: 30615
  subsp. aureus CIG1096

SEQ ID NO: 36672 - protein, 327 aa, Staphylococcus aureus; identical to SEQ ID NO: 30616
  subsp. aureus CIG1096

SEQ ID NO: 36673 - protein, 311 aa, Staphylococcus aureus; identical to SEQ ID NO: 30617
  subsp. aureus CIG1096

SEQ ID NO: 36674 - protein, 239 aa, Staphylococcus aureus
  subsp. aureus CIG1096
MNYVNAQPDPKLDELNKVSDYKNNKGTMGNVMNLYTSPPVEGRGVINSRQFLSHDLIFPIEYKSYNEVKTELENTELANNYKDKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 36675 - protein, 251 aa, Staphylococcus aureus; identical to SEQ ID NO: 30946
  subsp. aureus CIG1096

SEQ ID NO: 36676 - protein, 37 aa, Staphylococcus aureus; identical to SEQ ID NO: 30806
  subsp. aureus CIG1096

SEQ ID NO: 36677 - protein, 242 aa, Staphylococcus aureus; identical to SEQ ID NO: 30399
  subsp. aureus CIG1096

SEQ ID NO: 36678 - protein, 181 aa, Staphylococcus aureus
  subsp. aureus CIG1096
MDNSTVTAEFKNVDDVKKFKNHAVDVYGLSYSGYCLKNKYIYGGVTLAGDYLEKSRRIPINLWVNGEHQTISTDKVSTNKKLVTAQEIDTKLRRYLQEEYNIYGFNDTNKGRNYGNKSKFSSGFNAGKILFHLNDGSSFSYDLFDTGTGQAESFLKIYNDNKTVETEKFHLDVEISYKDES

SEQ ID NO: 36679 - protein, 254 aa, Staphylococcus aureus; identical to SEQ ID NO: 30809
  subsp. aureus CIG1096

SEQ ID NO: 36680 - protein, 274 aa, Staphylococcus aureus; identical to SEQ ID NO: 30815
  subsp. aureus CIG1096

SEQ ID NO: 36681 - protein, 338 aa, Staphylococcus aureus; identical to SEQ ID NO: 30627
  subsp. aureus CIG1096

SEQ ID NO: 36682 - protein, 351 aa, Staphylococcus aureus; identical to SEQ ID NO: 30628
  subsp. aureus CIG1096

SEQ ID NO: 36683 - protein, 44 aa, Staphylococcus aureus; identical to SEQ ID NO: 30513
  subsp. aureus CIG1096

SEQ ID NO: 36684 - protein, 231 aa, Staphylococcus aureus; identical to SEQ ID NO: 30630
  subsp. aureus CIG1096

SEQ ID NO: 36685 - protein, 2481 aa, Staphylococcus aureus
  subsp. aureus CIG1096
MNLFRQQKFIIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 36686 - protein, 258 aa, Staphylococcus aureus; identical to SEQ ID NO: 30228
  subsp. aureus CIG1096

SEQ ID NO: 36687 - protein, 268 aa, Staphylococcus aureus; identical to SEQ ID NO: 30398
  subsp. aureus CIG1096

SEQ ID NO: 36688 - protein, 233 aa, Staphylococcus aureus; identical to SEQ ID NO: 30428
  subsp. aureus CIG1114

SEQ ID NO: 36689 - protein, 879 aa, Staphylococcus aureus
  subsp. aureus CIG1114
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKTPSNPKGEVNHSNKVSKQHKTDALPETGDKSENTNATLFGAMMALLGSLLLFRKRKQDHKEKA

SEQ ID NO: 36690 - protein, 1503 aa, Staphylococcus aureus; identical to SEQ ID NO: 33069
  subsp. aureus CIG1114

SEQ ID NO: 36691 - protein, 681 aa, Staphylococcus aureus; identical to SEQ ID NO: 32025
  subsp. aureus CIG1114

SEQ ID NO: 36692 - protein, 241 aa, Staphylococcus aureus; identical to SEQ ID NO: 30776
  subsp. aureus CIG1114

SEQ ID NO: 36693 - protein, 508 aa, Staphylococcus aureus; identical to SEQ ID NO: 34278
  subsp. aureus CIG1114

SEQ ID NO: 36694 - protein, 807 aa, Staphylococcus aureus; identical to SEQ ID NO: 30716
  subsp. aureus CIG1114

SEQ ID NO: 36695 - protein, 141 aa, Staphylococcus aureus; identical to SEQ ID NO: 30715
  subsp. aureus CIG1114

SEQ ID NO: 36696 - protein, 309 aa, Staphylococcus aureus; identical to SEQ ID NO: 30406
  subsp. aureus CIG1114

SEQ ID NO: 36697 - protein, 315 aa, Staphylococcus aureus; identical to SEQ ID NO: 30440
  subsp. aureus CIG1114

SEQ ID NO: 36698 - protein, 325 aa, Staphylococcus aureus; identical to SEQ ID NO: 30407
  subsp. aureus CIG1114

SEQ ID NO: 36699 - protein, 191 aa, Staphylococcus aureus
  subsp. aureus CIG1114
MDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 36700 - protein, 444 aa, Staphylococcus aureus; identical to SEQ ID NO: 32034
  subsp. aureus CIG1114

SEQ ID NO: 36701 - protein, 931 aa, Staphylococcus aureus
  subsp. aureus CIG1114
MIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKRNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 36702 - protein, 995 aa, Staphylococcus aureus; identical to SEQ ID NO: 31038
  subsp. aureus CIG1114

SEQ ID NO: 36703 - protein, 690 aa, Staphylococcus aureus; identical to SEQ ID NO: 30419
  subsp. aureus CIG1114

SEQ ID NO: 36704 - protein, 203 aa, Staphylococcus aureus; identical to SEQ ID NO: 30770
  subsp. aureus CIG1114

SEQ ID NO: 36705 - protein, 226 aa, Staphylococcus aureus; identical to SEQ ID NO: 30769
  subsp. aureus CIG1114

SEQ ID NO: 36706 - protein, 231 aa, Staphylococcus aureus; identical to SEQ ID NO: 30768
  subsp. aureus CIG1114

SEQ ID NO: 36707 - protein, 67 aa, Staphylococcus aureus
  subsp. aureus CIG1114
MKELDFKLRKQLIEKNNLYGNVGSGKIVIKMKNGGKYTFELHKKLQENRMADVIDGTNIDNIEVNIK

SEQ ID NO: 36708 - protein, 234 aa, Staphylococcus aureus; identical to SEQ ID NO: 31052
  subsp. aureus CIG1114

SEQ ID NO: 36709 - protein, 231 aa, Staphylococcus aureus; identical to SEQ ID NO: 31761
  subsp. aureus CIG1114

SEQ ID NO: 36710 - protein, 231 aa, Staphylococcus aureus; identical to SEQ ID NO: 30560
  subsp. aureus CIG1114

SEQ ID NO: 36711 - protein, 232 aa, Staphylococcus aureus; identical to SEQ ID NO: 31054
  subsp. aureus CIG1114

SEQ ID NO: 36712 - protein, 232 aa, Staphylococcus aureus; identical to SEQ ID NO: 30765
  subsp. aureus CIG1114

SEQ ID NO: 36713 - protein, 227 aa, Staphylococcus aureus; identical to SEQ ID NO: 30585
  subsp. aureus CIG1114

SEQ ID NO: 36714 - protein, 225 aa, Staphylococcus aureus; identical to SEQ ID NO: 30763
  subsp. aureus CIG1114

SEQ ID NO: 36715 - protein, 434 aa, Staphylococcus aureus [sequence omitted]

SEQ ID NO: 36716 - protein, 931 aa, Staphylococcus aureus
  subsp. aureus CIG1114
MKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 36717 - protein, 242 aa, Staphylococcus aureus; identical to SEQ ID NO: 30536
  subsp. aureus CIG1114

SEQ ID NO: 36718 - protein, 231 aa, Staphylococcus aureus
  subsp. aureus CIG1114
MFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYDDNKTIDTENFHLDVEISYEKTE

SEQ ID NO: 36719 - protein, 126 aa, Staphylococcus aureus
  subsp. aureus CIG1114
MYGGVTEHNGNQLDKYRSITVRVFEDGKNLLSFDVQTNKKKVTAQELDYLTRHYLVKNKKLYEFNNSPYETGYIKFIENENSFWYDMMPAPGDKFDQSKYLMMYNDNKMVDSKDVKIEVYLTTKKK

SEQ ID NO: 36720 - protein, 645 aa, Staphylococcus aureus; identical to SEQ ID NO: 30747
  subsp. aureus CIG1114

SEQ ID NO: 36721 - protein, 350 aa, Staphylococcus aureus; identical to SEQ ID NO: 30602
  subsp. aureus CIG1114

SEQ ID NO: 36722 - protein, 109 aa, Staphylococcus aureus; identical to SEQ ID NO: 30744
  subsp. aureus CIG1114

SEQ ID NO: 36723 - protein, 165 aa, Staphylococcus aureus; identical to SEQ ID NO: 30742
  subsp. aureus CIG1114

SEQ ID NO: 36724 - protein, 319 aa, Staphylococcus aureus; identical to SEQ ID NO: 30741
  subsp. aureus CIG1114

SEQ ID NO: 36725 - protein, 238 aa, Staphylococcus aureus; identical to SEQ ID NO: 30740
  subsp. aureus CIG1114

SEQ ID NO: 36726 - protein, 241 aa, Staphylococcus aureus; identical to SEQ ID NO: 30739
  subsp. aureus CIG1114

SEQ ID NO: 36727 - protein, 241 aa, Staphylococcus aureus; identical to SEQ ID NO: 30738
  subsp. aureus CIG1114

SEQ ID NO: 36728 - protein, 372 aa, Staphylococcus aureus; identical to SEQ ID NO: 31084
  subsp. aureus CIG1114

SEQ ID NO: 36729 - protein, 929 aa, Staphylococcus aureus; identical to SEQ ID NO: 33226
  subsp. aureus CIG1114

SEQ ID NO: 36730 - protein, 1375 aa, Staphylococcus aureus
  subsp. aureus CIG1114
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 36731 - protein, 1148 aa, Staphylococcus aureus
  subsp. aureus CIG1114
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 36732 - protein, 250 aa, Staphylococcus aureus; identical to SEQ ID NO: 31910
  subsp. aureus CIG1114

SEQ ID NO: 36733 - protein, 291 aa, Staphylococcus aureus; identical to SEQ ID NO: 30390
  subsp. aureus CIG1114

SEQ ID NO: 36734 - protein, 895 aa, Staphylococcus aureus
  subsp. aureus CIG1114
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYSKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 36735 - protein, 2186 aa, Staphylococcus aureus; identical to SEQ ID NO: 33090
  subsp. aureus CIG1114

SEQ ID NO: 36736 - protein, 331 aa, Staphylococcus aureus; identical to SEQ ID NO: 30732
  subsp. aureus CIG1114

SEQ ID NO: 36737 - protein, 327 aa, Staphylococcus aureus; identical to SEQ ID NO: 30538
  subsp. aureus CIG1114

SEQ ID NO: 36738 - protein, 311 aa, Staphylococcus aureus; identical to SEQ ID NO: 30617
  subsp. aureus CIG1114

SEQ ID NO: 36739 - protein, 257 aa, Staphylococcus aureus; identical to SEQ ID NO: 30259
  subsp. aureus CIG1114

SEQ ID NO: 36740 - protein, 274 aa, Staphylococcus aureus; identical to SEQ ID NO: 30872
  subsp. aureus CIG1114

SEQ ID NO: 36741 - protein, 338 aa, Staphylococcus aureus; identical to SEQ ID NO: 30699
  subsp. aureus CIG1114

SEQ ID NO: 36742 - protein, 351 aa, Staphylococcus aureus; identical to SEQ ID NO: 30720
  subsp. aureus CIG1114

SEQ ID NO: 36743 - protein, 44 aa, Staphylococcus aureus; identical to SEQ ID NO: 30513
  subsp. aureus CIG1114

SEQ ID NO: 36744 - protein, 231 aa, Staphylococcus aureus; identical to SEQ ID NO: 31073
  subsp. aureus CIG1114

SEQ ID NO: 36745 - protein, 2478 aa, Staphylococcus aureus
  subsp. aureus CIG1114
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANESTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNVENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 36746 - protein, 259 aa, Staphylococcus aureus; identical to SEQ ID NO: 30226
  subsp. aureus CIG1150

SEQ ID NO: 36747 - protein, 268 aa, Staphylococcus aureus; identical to SEQ ID NO: 30230
  subsp. aureus CIG1150

SEQ ID NO: 36748 - protein, 67 aa, Staphylococcus aureus; identical to SEQ ID NO: 30231
  subsp. aureus CIG1150

SEQ ID NO: 36749 - protein, 257 aa, Staphylococcus aureus; identical to SEQ ID NO: 30232
  subsp. aureus CIG1150

SEQ ID NO: 36750 - protein, 809 aa, Staphylococcus aureus; identical to SEQ ID NO: 30632
  subsp. aureus CIG1150

SEQ ID NO: 36751 - protein, 141 aa, Staphylococcus aureus; identical to SEQ ID NO: 30633
  subsp. aureus CIG1150

SEQ ID NO: 36752 - protein, 233 aa, Staphylococcus aureus; identical to SEQ ID NO: 30591
  subsp. aureus CIG1150

SEQ ID NO: 36753 - protein, 211 aa, Staphylococcus aureus; identical to SEQ ID NO: 30592
  subsp. aureus CIG1150

SEQ ID NO: 36754 - protein, 877 aa, Staphylococcus aureus; identical to SEQ ID NO: 30593
  subsp. aureus CIG1150

SEQ ID NO: 36755 - protein, 2271 aa, Staphylococcus aureus; identical to SEQ ID NO: 30597
  subsp. aureus CIG1150

SEQ ID NO: 36756 - protein, 681 aa, Staphylococcus aureus; identical to SEQ ID NO: 30598
  subsp. aureus CIG1150

SEQ ID NO: 36757 - protein, 309 aa, Staphylococcus aureus; identical to SEQ ID NO: 30406
  subsp. aureus CIG1150

SEQ ID NO: 36758 - protein, 315 aa, Staphylococcus aureus; identical to SEQ ID NO: 30573
  subsp. aureus CIG1150

SEQ ID NO: 36759 - protein, 325 aa, Staphylococcus aureus; identical to SEQ ID NO: 30407
  subsp. aureus CIG1150

SEQ ID NO: 36760 - protein, 987 aa, Staphylococcus aureus
  subsp. aureus CIG1150
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 36761 - protein, 987 aa, Staphylococcus aureus
  subsp. aureus CIG1150
MIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 36762 - protein, 508 aa, Staphylococcus aureus; identical to SEQ ID NO: 30782
  subsp. aureus CIG1150

SEQ ID NO: 36763 - protein, 241 aa, Staphylococcus aureus; identical to SEQ ID NO: 30571
  subsp. aureus CIG1150

SEQ ID NO: 36764 - protein, 691 aa, Staphylococcus aureus
  subsp. aureus CIG1150
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPSQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFINVTNDEPATRRGIWQVKPIIQGWDHVDFIGVDFLDFKRKGAELANFYTGIINDLLRVEATESKGTQLKAS

SEQ ID NO: 36765 - protein, 203 aa, Staphylococcus aureus; identical to SEQ ID NO: 30576
  subsp. aureus CIG1150

SEQ ID NO: 36766 - protein, 226 aa, Staphylococcus aureus; identical to SEQ ID NO: 30577
  subsp. aureus CIG1150

SEQ ID NO: 36767 - protein, 231 aa, Staphylococcus aureus; identical to SEQ ID NO: 30578
  subsp. aureus CIG1150

SEQ ID NO: 36768 - protein, 274 aa, Staphylococcus aureus
  subsp. aureus CIG1150
MRKKTSASKIEKISQPKQEEQKSLNISATPAPKQEQSQTTTESTTPKTKVTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 36769 - protein, 292 aa, Staphylococcus aureus; identical to SEQ ID NO: 30580
  subsp. aureus CIG1150

SEQ ID NO: 36770 - protein, 234 aa, Staphylococcus aureus; identical to SEQ ID NO: 30581
  subsp. aureus CIG1150

SEQ ID NO: 36771 - protein, 231 aa, Staphylococcus aureus; identical to SEQ ID NO: 30582
  subsp. aureus CIG1150

SEQ ID NO: 36772 - protein, 232 aa, Staphylococcus aureus; identical to SEQ ID NO: 30583
  subsp. aureus CIG1150

SEQ ID NO: 36773 - protein, 232 aa, Staphylococcus aureus; identical to SEQ ID NO: 30584
  subsp. aureus CIG1150

SEQ ID NO: 36774 - protein, 227 aa, Staphylococcus aureus; identical to SEQ ID NO: 30585
  subsp. aureus CIG1150

SEQ ID NO: 36775 - protein, 227 aa, Staphylococcus aureus; identical to SEQ ID NO: 30586
  subsp. aureus CIG1150

SEQ ID NO: 36776 - protein, 967 aa, Staphylococcus aureus
  subsp. aureus CIG1150
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQIGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 36777 - protein, 1385 aa, Staphylococcus aureus
  subsp. aureus CIG1150
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTSTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 36778 - protein, 1153 aa, Staphylococcus aureus; identical to SEQ ID NO: 34894
  subsp. aureus CIG1150

SEQ ID NO: 36779 - protein, 434 aa, Staphylococcus aureus [sequence omitted]

SEQ ID NO: 36780 - protein, 839 aa, Staphylococcus aureus
  subsp. aureus CIG1150
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 36781 - protein, 645 aa, Staphylococcus aureus; identical to SEQ ID NO: 30601
  subsp. aureus CIG1150

SEQ ID NO: 36782 - protein, 350 aa, Staphylococcus aureus; identical to SEQ ID NO: 30602
  subsp. aureus CIG1150

SEQ ID NO: 36783 - protein, 109 aa, Staphylococcus aureus
  subsp. aureus CIG1150
MKKNFIGKSILSIAAINLTVSTFAGESHAQTKNVEAAKKYDQYQTNFKKQVNKKVVDAQKAVNLFKRTRTVATHRKAQRAVNLIHFQHSYEKKKLQRQIDLVLKYNTLK

SEQ ID NO: 36784 - protein, 165 aa, Staphylococcus aureus; identical to SEQ ID NO: 30418
  subsp. aureus CIG1150

SEQ ID NO: 36785 - protein, 319 aa, Staphylococcus aureus; identical to SEQ ID NO: 30605
  subsp. aureus CIG1150

SEQ ID NO: 36786 - protein, 238 aa, Staphylococcus aureus; identical to SEQ ID NO: 30606
  subsp. aureus CIG1150

SEQ ID NO: 36787 - protein, 241 aa, Staphylococcus aureus; identical to SEQ ID NO: 30607
  subsp. aureus CIG1150

SEQ ID NO: 36788 - protein, 241 aa, Staphylococcus aureus; identical to SEQ ID NO: 30608
  subsp. aureus CIG1150

SEQ ID NO: 36789 - protein, 372 aa, Staphylococcus aureus; identical to SEQ ID NO: 30609
  subsp. aureus CIG1150

SEQ ID NO: 36790 - protein, 62 aa, Staphylococcus aureus; identical to SEQ ID NO: 30610
  subsp. aureus CIG1150

SEQ ID NO: 36791 - protein, 138 aa, Staphylococcus aureus; identical to SEQ ID NO: 30785
  subsp. aureus CIG1150

SEQ ID NO: 36792 - protein, 891 aa, Staphylococcus aureus; identical to SEQ ID NO: 34909
  subsp. aureus CIG1150

SEQ ID NO: 36793 - protein, 2186 aa, Staphylococcus aureus; identical to SEQ ID NO: 30516
  subsp. aureus CIG1150

SEQ ID NO: 36794 - protein, 331 aa, Staphylococcus aureus; identical to SEQ ID NO: 30615
  subsp. aureus CIG1150

SEQ ID NO: 36795 - protein, 291 aa, Staphylococcus aureus; identical to SEQ ID NO: 30390
  subsp. aureus CIG1150

SEQ ID NO: 36796 - protein, 327 aa, Staphylococcus aureus; identical to SEQ ID NO: 30616
  subsp. aureus CIG1150

SEQ ID NO: 36797 - protein, 311 aa, Staphylococcus aureus; identical to SEQ ID NO: 30617
  subsp. aureus CIG1150

SEQ ID NO: 36798 - protein, 258 aa, Staphylococcus aureus; identical to SEQ ID NO: 30410
  subsp. aureus CIG1150

SEQ ID NO: 36799 - protein, 165 aa, Staphylococcus aureus; identical to SEQ ID NO: 30805
  subsp. aureus CIG1150

SEQ ID NO: 36800 - protein, 131 aa, Staphylococcus aureus; identical to SEQ ID NO: 30867
  subsp. aureus CIG1150

SEQ ID NO: 36801 - protein, 242 aa, Staphylococcus aureus; identical to SEQ ID NO: 30399
  subsp. aureus CIG1150

SEQ ID NO: 36802 - protein, 213 aa, Staphylococcus aureus
  subsp. aureus CIG1150
MNLRNYYGSYPIEDHQSINPENNHLSHQLVFSMDNSTVTAEFKNVDDVKKFKNHAVDVYGLSYSGYCLKNKYIYGGVTLAGDYLEKSRRIPINLWVNGEHQTISTDKVSTNKKLVTAQEIDTKLRRYLQEEYNIYGFNDTNKVRNYGNKSKFSSGFNAGKILFHLNDGSSFSYDLFDTGTGQAESFLKIYNDNKTVETEKFHLDVEISYKDES

SEQ ID NO: 36803 - protein, 254 aa, Staphylococcus aureus; identical to SEQ ID NO: 30809
  subsp. aureus CIG1150

SEQ ID NO: 36804 - protein, 231 aa, Staphylococcus aureus; identical to SEQ ID NO: 30630
  subsp. aureus CIG1150

SEQ ID NO: 36805 - protein, 2307 aa, Staphylococcus aureus
  subsp. aureus CIG1150
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGTTNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 36806 - protein, 222 aa, Staphylococcus aureus
  subsp. aureus CIG1150
MQKKSELQGTALSNLRQTYYHNGSAIIENKESNDQFLKNTILFNDFFTGHQWYNDLLVDLGSKDTANIYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTQLRIYRDNKTIKSKNMHIDIYLYTT

SEQ ID NO: 36807 - protein, 274 aa, Staphylococcus aureus
  subsp. aureus CIG1150
MYPNWGQYKRADLIGQSSYIKNNDVVIFNEAFDNGASDKLLSNVKKEYPYQTPVLGHSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 36808 - protein, 338 aa, Staphylococcus aureus; identical to SEQ ID NO: 30627
  subsp. aureus CIG1150

SEQ ID NO: 36809 - protein, 351 aa, Staphylococcus aureus; identical to SEQ ID NO: 30628
  subsp. aureus CIG1150

SEQ ID NO: 36810 - protein, 44 aa, Staphylococcus aureus; identical to SEQ ID NO: 30513
  subsp. aureus CIG1150

SEQ ID NO: 36811 - protein, 196 aa, Staphylococcus aureus; identical to SEQ ID NO: 30587
  subsp. aureus CIG1165

SEQ ID NO: 36812 - protein, 535 aa, Staphylococcus aureus
  subsp. aureus CIG1165
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGE

SEQ ID NO: 36813 - protein, 938 aa, Staphylococcus aureus; identical to SEQ ID NO: 36569
  subsp. aureus CIG1165

SEQ ID NO: 36814 - protein, 1015 aa, Staphylococcus aureus; identical to SEQ ID NO: 36570
  subsp. aureus CIG1165

SEQ ID NO: 36815 - protein, 233 aa, Staphylococcus aureus; identical to SEQ ID NO: 30591
  subsp. aureus CIG1165

SEQ ID NO: 36816 - protein, 211 aa, Staphylococcus aureus; identical to SEQ ID NO: 30592
  subsp. aureus CIG1165

SEQ ID NO: 36817 - protein, 877 aa, Staphylococcus aureus; identical to SEQ ID NO: 30593
  subsp. aureus CIG1165

SEQ ID NO: 36818 - protein, 2271 aa, Staphylococcus aureus; identical to SEQ ID NO: 30597
  subsp. aureus CIG1165

SEQ ID NO: 36819 - protein, 681 aa, Staphylococcus aureus; identical to SEQ ID NO: 30598
  subsp. aureus CIG1165

SEQ ID NO: 36820 - protein, 809 aa, Staphylococcus aureus; identical to SEQ ID NO: 30632
  subsp. aureus CIG1165

SEQ ID NO: 36821 - protein, 141 aa, Staphylococcus aureus; identical to SEQ ID NO: 30633
  subsp. aureus CIG1165

SEQ ID NO: 36822 - protein, 309 aa, Staphylococcus aureus; identical to SEQ ID NO: 30406
  subsp. aureus CIG1165

SEQ ID NO: 36823 - protein, 315 aa, Staphylococcus aureus; identical to SEQ ID NO: 30573
  subsp. aureus CIG1165

SEQ ID NO: 36824 - protein, 325 aa, Staphylococcus aureus; identical to SEQ ID NO: 36567
  subsp. aureus CIG1165

SEQ ID NO: 36825 - protein, 508 aa, Staphylococcus aureus; identical to SEQ ID NO: 30782
  subsp. aureus CIG1165

SEQ ID NO: 36826 - protein, 241 aa, Staphylococcus aureus; identical to SEQ ID NO: 30571
  subsp. aureus CIG1165

SEQ ID NO: 36827 - protein, 691 aa, Staphylococcus aureus; identical to SEQ ID NO: 30511
  subsp. aureus CIG1165

SEQ ID NO: 36828 - protein, 203 aa, Staphylococcus aureus; identical to SEQ ID NO: 30576
  subsp. aureus CIG1165

SEQ ID NO: 36829 - protein, 226 aa, Staphylococcus aureus; identical to SEQ ID NO: 30577
  subsp. aureus CIG1165

SEQ ID NO: 36830 - protein, 231 aa, Staphylococcus aureus; identical to SEQ ID NO: 30578
  subsp. aureus CIG1165

SEQ ID NO: 36831 - protein, 356 aa, Staphylococcus aureus; identical to SEQ ID NO: 30579
  subsp. aureus CIG1165

SEQ ID NO: 36832 - protein, 292 aa, Staphylococcus aureus; identical to SEQ ID NO: 30580
  subsp. aureus CIG1165

SEQ ID NO: 36833 - protein, 234 aa, Staphylococcus aureus; identical to SEQ ID NO: 30581
  subsp. aureus CIG1165

SEQ ID NO: 36834 - protein, 231 aa, Staphylococcus aureus; identical to SEQ ID NO: 30582
  subsp. aureus CIG1165

SEQ ID NO: 36835 - protein, 232 aa, Staphylococcus aureus; identical to SEQ ID NO: 30583
  subsp. aureus CIG1165

SEQ ID NO: 36836 - protein, 232 aa, Staphylococcus aureus; identical to SEQ ID NO: 30584
  subsp. aureus CIG1165

SEQ ID NO: 36837 - protein, 227 aa, Staphylococcus aureus; identical to SEQ ID NO: 30585
  subsp. aureus CIG1165

SEQ ID NO: 36838 - protein, 227 aa, Staphylococcus aureus; identical to SEQ ID NO: 30586
  subsp. aureus CIG1165

SEQ ID NO: 36839 - protein, 959 aa, Staphylococcus aureus
  subsp. aureus CIG1165
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 36840 - protein, 1337 aa, Staphylococcus aureus; identical to SEQ ID NO: 36591
  subsp. aureus CIG1165

SEQ ID NO: 36841 - protein, 1153 aa, Staphylococcus aureus; identical to SEQ ID NO: 30596
  subsp. aureus CIG1165

SEQ ID NO: 36842 - protein, 434 aa, Staphylococcus aureus [sequence omitted]

SEQ ID NO: 36843 - protein, 905 aa, Staphylococcus aureus; identical to SEQ ID NO: 30600
  subsp. aureus CIG1165

SEQ ID NO: 36844 - protein, 254 aa, Staphylococcus aureus
  subsp. aureus CIG1165
MVDDAITRILKDNATDLLNKDFKEKIDKDVISYIEKNESRFKGAKGDKGEPGQPGAKGEAGKKGEQGAPGKNGTVVSINPDTKMWQIDGKDTDIKAEPELLEKSISQMLKVRNKLQEVEKIKDTTLNDSKTYTDSKIAELVDSAPESMNTLRELAEAIQNNSISESVLQQIGSKVSTEDFEEFKQTLNDLYAPKNHNHDERYVLSSQAFTKQQADNLYQLKSASQPTVKIWTGTENEYNYIYQKDPNTLYLIKG

SEQ ID NO: 36845 - protein, 645 aa, Staphylococcus aureus; identical to SEQ ID NO: 30601
  subsp. aureus CIG1165

SEQ ID NO: 36846 - protein, 350 aa, Staphylococcus aureus; identical to SEQ ID NO: 30602
  subsp. aureus CIG1165

SEQ ID NO: 36847 - protein, 109 aa, Staphylococcus aureus; identical to SEQ ID NO: 30603
  subsp. aureus CIG1165

SEQ ID NO: 36848 - protein, 165 aa, Staphylococcus aureus; identical to SEQ ID NO: 30418
  subsp. aureus CIG1165

SEQ ID NO: 36849 - protein, 319 aa, Staphylococcus aureus; identical to SEQ ID NO: 30605
  subsp. aureus CIG1165

SEQ ID NO: 36850 - protein, 238 aa, Staphylococcus aureus; identical to SEQ ID NO: 30606
  subsp. aureus CIG1165

SEQ ID NO: 36851 - protein, 241 aa, Staphylococcus aureus; identical to SEQ ID NO: 30607
  subsp. aureus CIG1165

SEQ ID NO: 36852 - protein, 241 aa, Staphylococcus aureus; identical to SEQ ID NO: 30608
  subsp. aureus CIG1165

SEQ ID NO: 36853 - protein, 372 aa, Staphylococcus aureus; identical to SEQ ID NO: 30609
  subsp. aureus CIG1165

SEQ ID NO: 36854 - protein, 62 aa, Staphylococcus aureus; identical to SEQ ID NO: 30610
  subsp. aureus CIG1165

SEQ ID NO: 36855 - protein, 138 aa, Staphylococcus aureus; identical to SEQ ID NO: 30785
  subsp. aureus CIG1165

SEQ ID NO: 36856 - protein, 291 aa, Staphylococcus aureus; identical to SEQ ID NO: 30390
  subsp. aureus CIG1165

SEQ ID NO: 36857 - protein, 891 aa, Staphylococcus aureus; identical to SEQ ID NO: 30788
  subsp. aureus CIG1165

SEQ ID NO: 36858 - protein, 2186 aa, Staphylococcus aureus; identical to SEQ ID NO: 36618
  subsp. aureus CIG1165

SEQ ID NO: 36859 - protein, 331 aa, Staphylococcus aureus; identical to SEQ ID NO: 30615
  subsp. aureus CIG1165

SEQ ID NO: 36860 - protein, 327 aa, Staphylococcus aureus; identical to SEQ ID NO: 30616
  subsp. aureus CIG1165

SEQ ID NO: 36861 - protein, 311 aa, Staphylococcus aureus; identical to SEQ ID NO: 30617
  subsp. aureus CIG1165

SEQ ID NO: 36862 - protein, 258 aa, Staphylococcus aureus; identical to SEQ ID NO: 30410
  subsp. aureus CIG1165

SEQ ID NO: 36863 - protein, 251 aa, Staphylococcus aureus; identical to SEQ ID NO: 30946
  subsp. aureus CIG1165

SEQ ID NO: 36864 - protein, 131 aa, Staphylococcus aureus; identical to SEQ ID NO: 30867
  subsp. aureus CIG1165

SEQ ID NO: 36865 - protein, 242 aa, Staphylococcus aureus; identical to SEQ ID NO: 30399
  subsp. aureus CIG1165

SEQ ID NO: 36866 - protein, 239 aa, Staphylococcus aureus; identical to SEQ ID NO: 30622
  subsp. aureus CIG1165

SEQ ID NO: 36867 - protein, 254 aa, Staphylococcus aureus; identical to SEQ ID NO: 30809
  subsp. aureus CIG1165

SEQ ID NO: 36868 - protein, 330 aa, Staphylococcus aureus; identical to SEQ ID NO: 32434
  subsp. aureus CIG1165

SEQ ID NO: 36869 - protein, 338 aa, Staphylococcus aureus; identical to SEQ ID NO: 30627
  subsp. aureus CIG1165

SEQ ID NO: 36870 - protein, 351 aa, Staphylococcus aureus; identical to SEQ ID NO: 36621
  subsp. aureus CIG1165

SEQ ID NO: 36871 - protein, 44 aa, Staphylococcus aureus; identical to SEQ ID NO: 30513
  subsp. aureus CIG1165

SEQ ID NO: 36872 - protein, 96 aa, Staphylococcus aureus; identical to SEQ ID NO: 30813
  subsp. aureus CIG1165

SEQ ID NO: 36873 - protein, 231 aa, Staphylococcus aureus; identical to SEQ ID NO: 30630
  subsp. aureus CIG1165

SEQ ID NO: 36874 - protein, 2481 aa, Staphylococcus aureus; identical to SEQ ID NO: 30631
  subsp. aureus CIG1165

SEQ ID NO: 36875 - protein, 873 aa, Staphylococcus aureus; identical to SEQ ID NO: 31205
  subsp. aureus CIG1176

SEQ ID NO: 36876 - protein, 1351 aa, Staphylococcus aureus; identical to SEQ ID NO: 31203
  subsp. aureus CIG1176

SEQ ID NO: 36877 - protein, 681 aa, Staphylococcus aureus; identical to SEQ ID NO: 34710
  subsp. aureus CIG1176

SEQ ID NO: 36878 - protein, 809 aa, Staphylococcus aureus
  subsp. aureus CIG1176
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 36879 - protein, 808 aa, Staphylococcus aureus; identical to SEQ ID NO: 31215
  subsp. aureus CIG1176

SEQ ID NO: 36880 - protein, 141 aa, Staphylococcus aureus; identical to SEQ ID NO: 31214
  subsp. aureus CIG1176

SEQ ID NO: 36881 - protein, 309 aa, Staphylococcus aureus; identical to SEQ ID NO: 33946
  subsp. aureus CIG1176

SEQ ID NO: 36882 - protein, 315 aa, Staphylococcus aureus; identical to SEQ ID NO: 31191
  subsp. aureus CIG1176

SEQ ID NO: 36883 - protein, 325 aa, Staphylococcus aureus; identical to SEQ ID NO: 30479
  subsp. aureus CIG1176

SEQ ID NO: 36884 - protein, 942 aa, Staphylococcus aureus
  subsp. aureus CIG1176
MIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGMSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQAKKSELPETGGEESTNKGMLFGGLFSILGLALLRRNKKNHKA

SEQ ID NO: 36885 - protein, 233 aa, Staphylococcus aureus; identical to SEQ ID NO: 31039
  subsp. aureus CIG1176

SEQ ID NO: 36886 - protein, 516 aa, Staphylococcus aureus; identical to SEQ ID NO: 31270
  subsp. aureus CIG1176

SEQ ID NO: 36887 - protein, 221 aa, Staphylococcus aureus; identical to SEQ ID NO: 31036
  subsp. aureus CIG1176

SEQ ID NO: 36888 - protein, 691 aa, Staphylococcus aureus; identical to SEQ ID NO: 31040
  subsp. aureus CIG1176

SEQ ID NO: 36889 - protein, 44 aa, Staphylococcus aureus; identical to SEQ ID NO: 30513
  subsp. aureus CIG1176

SEQ ID NO: 36890 - protein, 226 aa, Staphylococcus aureus; identical to SEQ ID NO: 31265
  subsp. aureus CIG1176

SEQ ID NO: 36891 - protein, 233 aa, Staphylococcus aureus; identical to SEQ ID NO: 31264
  subsp. aureus CIG1176

SEQ ID NO: 36892 - protein, 343 aa, Staphylococcus aureus; identical to SEQ ID NO: 31263
  subsp. aureus CIG1176

SEQ ID NO: 36893 - protein, 306 aa, Staphylococcus aureus; identical to SEQ ID NO: 31262
  subsp. aureus CIG1176

SEQ ID NO: 36894 - protein, 234 aa, Staphylococcus aureus; identical to SEQ ID NO: 30567
  subsp. aureus CIG1176

SEQ ID NO: 36895 - protein, 231 aa, Staphylococcus aureus; identical to SEQ ID NO: 30566
  subsp. aureus CIG1176

SEQ ID NO: 36896 - protein, 232 aa, Staphylococcus aureus; identical to SEQ ID NO: 30565
  subsp. aureus CIG1176

SEQ ID NO: 36897 - protein, 227 aa, Staphylococcus aureus; identical to SEQ ID NO: 30564
  subsp. aureus CIG1176

SEQ ID NO: 36898 - protein, 232 aa, Staphylococcus aureus; identical to SEQ ID NO: 31257
  subsp. aureus CIG1176

SEQ ID NO: 36899 - protein, 924 aa, Staphylococcus aureus; identical to SEQ ID NO: 34735
  subsp. aureus CIG1176

SEQ ID NO: 36900 - protein, 1374 aa, Staphylococcus aureus; identical to SEQ ID NO: 36154
  subsp. aureus CIG1176

SEQ ID NO: 36901 - protein, 1137 aa, Staphylococcus aureus; identical to SEQ ID NO: 31254
  subsp. aureus CIG1176

SEQ ID NO: 36902 - protein, 434 aa, Staphylococcus aureus [sequence omitted]

SEQ ID NO: 36903 - protein, 1029 aa, Staphylococcus aureus; identical to SEQ ID NO: 31250
  subsp. aureus CIG1176

SEQ ID NO: 36904 - protein, 270 aa, Staphylococcus aureus
  subsp. aureus CIG1176
DSGIESAVAKEIDVKLVDDAITRILKDNATDLLSKDFKEKIDKDVISYIEKNESRFKGAKGDKGEPGQPGAKGEAGKKGEQGAPGKNGTVVSINPDTKMWQIDGKDTDIKAEPELLDKINIANVEGLEDKLQEVEKIKDTTLNDSKTYTDTKIAELVDSAPESMNTLRELAEAIQNNSISESVLQQIGSKVSTEDFEKFKQTLNDLYAPKNHNHDERYVLSSQAFTKQQADNLYQLKSASQPTVKIWTGTENEYNYIYQKDPNTLYLIKG

SEQ ID NO: 36905 - protein, 652 aa, Staphylococcus aureus; identical to SEQ ID NO: 34746
  subsp. aureus CIG1176

SEQ ID NO: 36906 - protein, 354 aa, Staphylococcus aureus; identical to SEQ ID NO: 30412
  subsp. aureus CIG1176

SEQ ID NO: 36907 - protein, 105 aa, Staphylococcus aureus; identical to SEQ ID NO: 31168
  subsp. aureus CIG1176

SEQ ID NO: 36908 - protein, 165 aa, Staphylococcus aureus; identical to SEQ ID NO: 31241
  subsp. aureus CIG1176

SEQ ID NO: 36909 - protein, 206 aa, Staphylococcus aureus; identical to SEQ ID NO: 34750
  subsp. aureus CIG1176

SEQ ID NO: 36910 - protein, 112 aa, Staphylococcus aureus; identical to SEQ ID NO: 34751
  subsp. aureus CIG1176

SEQ ID NO: 36911 - protein, 238 aa, Staphylococcus aureus; identical to SEQ ID NO: 31240
  subsp. aureus CIG1176

SEQ ID NO: 36912 - protein, 241 aa, Staphylococcus aureus; identical to SEQ ID NO: 31239
  subsp. aureus CIG1176

SEQ ID NO: 36913 - protein, 241 aa, Staphylococcus aureus; identical to SEQ ID NO: 31238
  subsp. aureus CIG1176

SEQ ID NO: 36914 - protein, 372 aa, Staphylococcus aureus; identical to SEQ ID NO: 33950
  subsp. aureus CIG1176

SEQ ID NO: 36915 - protein, 62 aa, Staphylococcus aureus; identical to SEQ ID NO: 31886
  subsp. aureus CIG1176

SEQ ID NO: 36916 - protein, 167 aa, Staphylococcus aureus; identical to SEQ ID NO: 31885
  subsp. aureus CIG1176

SEQ ID NO: 36917 - protein, 270 aa, Staphylococcus aureus; identical to SEQ ID NO: 35140
  subsp. aureus CIG1176

SEQ ID NO: 36918 - protein, 278 aa, Staphylococcus aureus; identical to SEQ ID NO: 34714
  subsp. aureus CIG1176

SEQ ID NO: 36919 - protein, 2189 aa, Staphylococcus aureus; identical to SEQ ID NO: 31236
  subsp. aureus CIG1176

SEQ ID NO: 36920 - protein, 331 aa, Staphylococcus aureus; identical to SEQ ID NO: 31235
  subsp. aureus CIG1176

SEQ ID NO: 36921 - protein, 806 aa, Staphylococcus aureus; identical to SEQ ID NO: 31234
  subsp. aureus CIG1176

SEQ ID NO: 36922 - protein, 258 aa, Staphylococcus aureus; identical to SEQ ID NO: 30518
  subsp. aureus CIG1176

SEQ ID NO: 36923 - protein, 251 aa, Staphylococcus aureus; identical to SEQ ID NO: 30505
  subsp. aureus CIG1176

SEQ ID NO: 36924 - protein, 261 aa, Staphylococcus aureus; identical to SEQ ID NO: 30506
  subsp. aureus CIG1176

SEQ ID NO: 36925 - protein, 242 aa, Staphylococcus aureus; identical to SEQ ID NO: 30522
  subsp. aureus CIG1176

SEQ ID NO: 36926 - protein, 239 aa, Staphylococcus aureus; identical to SEQ ID NO: 30171
  subsp. aureus CIG1176

SEQ ID NO: 36927 - protein, 254 aa, Staphylococcus aureus; identical to SEQ ID NO: 31226
  subsp. aureus CIG1176

SEQ ID NO: 36928 - protein, 231 aa, Staphylococcus aureus; identical to SEQ ID NO: 31216
  subsp. aureus CIG1176

SEQ ID NO: 36929 - protein, 689 aa, Staphylococcus aureus; identical to SEQ ID NO: 31224
  subsp. aureus CIG1176

SEQ ID NO: 36930 - protein, 257 aa, Staphylococcus aureus; identical to SEQ ID NO: 31220
  subsp. aureus CIG1176

SEQ ID NO: 36931 - protein, 231 aa, Staphylococcus aureus
  subsp. aureus CIG1176
MKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTEEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 36932 - protein, 339 aa, Staphylococcus aureus; identical to SEQ ID NO: 31219
  subsp. aureus CIG1176

SEQ ID NO: 36933 - protein, 351 aa, Staphylococcus aureus; identical to SEQ ID NO: 31218
  subsp. aureus CIG1176

SEQ ID NO: 36934 - protein, 234 aa, Staphylococcus aureus; identical to SEQ ID NO: 30530
  subsp. aureus CIG1176

SEQ ID NO: 36935 - protein, 258 aa, Staphylococcus aureus; identical to SEQ ID NO: 30228
  subsp. aureus CIG1213

SEQ ID NO: 36936 - protein, 268 aa, Staphylococcus aureus; identical to SEQ ID NO: 30398
  subsp. aureus CIG1213

SEQ ID NO: 36937 - protein, 259 aa, Staphylococcus aureus; identical to SEQ ID NO: 30226
  subsp. aureus CIG1213

SEQ ID NO: 36938 - protein, 309 aa, Staphylococcus aureus; identical to SEQ ID NO: 30406
  subsp. aureus CIG1213

SEQ ID NO: 36939 - protein, 315 aa, Staphylococcus aureus; identical to SEQ ID NO: 30573
  subsp. aureus CIG1213

SEQ ID NO: 36940 - protein, 325 aa, Staphylococcus aureus; identical to SEQ ID NO: 30407
  subsp. aureus CIG1213

SEQ ID NO: 36941 - protein, 859 aa, Staphylococcus aureus; identical to SEQ ID NO: 36630
  subsp. aureus CIG1213

SEQ ID NO: 36942 - protein, 938 aa, Staphylococcus aureus
  subsp. aureus CIG1213
MIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 36943 - protein, 1010 aa, Staphylococcus aureus
  subsp. aureus CIG1213
MGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 36944 - protein, 233 aa, Staphylococcus aureus; identical to SEQ ID NO: 30591
  subsp. aureus CIG1213

SEQ ID NO: 36945 - protein, 211 aa, Staphylococcus aureus; identical to SEQ ID NO: 30592
  subsp. aureus CIG1213

SEQ ID NO: 36946 - protein, 877 aa, Staphylococcus aureus; identical to SEQ ID NO: 30593
  subsp. aureus CIG1213

SEQ ID NO: 36947 - protein, 2271 aa, Staphylococcus aureus
  subsp. aureus CIG1213
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKIRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 36948 - protein, 681 aa, Staphylococcus aureus; identical to SEQ ID NO: 30598
  subsp. aureus CIG1213

SEQ ID NO: 36949 - protein, 691 aa, Staphylococcus aureus; identical to SEQ ID NO: 30511
  subsp. aureus CIG1213

SEQ ID NO: 36950 - protein, 203 aa, Staphylococcus aureus; identical to SEQ ID NO: 30576
  subsp. aureus CIG1213

SEQ ID NO: 36951 - protein, 226 aa, Staphylococcus aureus; identical to SEQ ID NO: 30577
  subsp. aureus CIG1213

SEQ ID NO: 36952 - protein, 231 aa, Staphylococcus aureus; identical to SEQ ID NO: 30578
  subsp. aureus CIG1213

SEQ ID NO: 36953 - protein, 356 aa, Staphylococcus aureus; identical to SEQ ID NO: 30579
  subsp. aureus CIG1213

SEQ ID NO: 36954 - protein, 292 aa, Staphylococcus aureus; identical to SEQ ID NO: 30580
  subsp. aureus CIG1213

SEQ ID NO: 36955 - protein, 234 aa, Staphylococcus aureus; identical to SEQ ID NO: 30581
  subsp. aureus CIG1213

SEQ ID NO: 36956 - protein, 231 aa, Staphylococcus aureus; identical to SEQ ID NO: 30582
  subsp. aureus CIG1213

SEQ ID NO: 36957 - protein, 232 aa, Staphylococcus aureus; identical to SEQ ID NO: 30583
  subsp. aureus CIG1213

SEQ ID NO: 36958 - protein, 232 aa, Staphylococcus aureus; identical to SEQ ID NO: 30584
  subsp. aureus CIG1213

SEQ ID NO: 36959 - protein, 227 aa, Staphylococcus aureus; identical to SEQ ID NO: 30585
  subsp. aureus CIG1213

SEQ ID NO: 36960 - protein, 227 aa, Staphylococcus aureus; identical to SEQ ID NO: 30586
  subsp. aureus CIG1213

SEQ ID NO: 36961 - protein, 508 aa, Staphylococcus aureus; identical to SEQ ID NO: 30782
  subsp. aureus CIG1213

SEQ ID NO: 36962 - protein, 241 aa, Staphylococcus aureus; identical to SEQ ID NO: 30571
  subsp. aureus CIG1213

SEQ ID NO: 36963 - protein, 965 aa, Staphylococcus aureus; identical to SEQ ID NO: 30920
  subsp. aureus CIG1213

SEQ ID NO: 36964 - protein, 1337 aa, Staphylococcus aureus; identical to SEQ ID NO: 30811
  subsp. aureus CIG1213

SEQ ID NO: 36965 - protein, 1103 aa, Staphylococcus aureus
  subsp. aureus CIG1213
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 36966 - protein, 434 aa, Staphylococcus aureus [sequence omitted]

SEQ ID NO: 36967 - protein, 905 aa, Staphylococcus aureus; identical to SEQ ID NO: 30600
  subsp. aureus CIG1213

SEQ ID NO: 36968 - protein, 645 aa, Staphylococcus aureus; identical to SEQ ID NO: 30601
  subsp. aureus CIG1213

SEQ ID NO: 36969 - protein, 350 aa, Staphylococcus aureus; identical to SEQ ID NO: 30602
  subsp. aureus CIG1213

SEQ ID NO: 36970 - protein, 109 aa, Staphylococcus aureus; identical to SEQ ID NO: 30603
  subsp. aureus CIG1213

SEQ ID NO: 36971 - protein, 165 aa, Staphylococcus aureus; identical to SEQ ID NO: 30418
  subsp. aureus CIG1213

SEQ ID NO: 36972 - protein, 319 aa, Staphylococcus aureus; identical to SEQ ID NO: 30605
  subsp. aureus CIG1213

SEQ ID NO: 36973 - protein, 238 aa, Staphylococcus aureus; identical to SEQ ID NO: 30606
  subsp. aureus CIG1213

SEQ ID NO: 36974 - protein, 241 aa, Staphylococcus aureus; identical to SEQ ID NO: 30607
  subsp. aureus CIG1213

SEQ ID NO: 36975 - protein, 241 aa, Staphylococcus aureus; identical to SEQ ID NO: 30608
  subsp. aureus CIG1213

SEQ ID NO: 36976 - protein, 372 aa, Staphylococcus aureus; identical to SEQ ID NO: 30609
  subsp. aureus CIG1213

SEQ ID NO: 36977 - protein, 62 aa, Staphylococcus aureus; identical to SEQ ID NO: 30610
  subsp. aureus CIG1213

SEQ ID NO: 36978 - protein, 138 aa, Staphylococcus aureus; identical to SEQ ID NO: 30785
  subsp. aureus CIG1213

SEQ ID NO: 36979 - protein, 291 aa, Staphylococcus aureus; identical to SEQ ID NO: 30390
  subsp. aureus CIG1213

SEQ ID NO: 36980 - protein, 891 aa, Staphylococcus aureus; identical to SEQ ID NO: 30788
  subsp. aureus CIG1213

SEQ ID NO: 36981 - protein, 2186 aa, Staphylococcus aureus
  subsp. aureus CIG1213
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADTLKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 36982 - protein, 331 aa, Staphylococcus aureus; identical to SEQ ID NO: 30615
  subsp. aureus CIG1213

SEQ ID NO: 36983 - protein, 67 aa, Staphylococcus aureus
  subsp. aureus CIG1213
MIQKSKIKVTYQREMDRYTNQWNRLHWIGNNYKNQNTVTFTSTYEVDWQNHTVKLIGTDSKETNPGV

SEQ ID NO: 36984 - protein, 264 aa, Staphylococcus aureus
  subsp. aureus CIG1213
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKI

SEQ ID NO: 36985 - protein, 311 aa, Staphylococcus aureus; identical to SEQ ID NO: 30617
  subsp. aureus CIG1213

SEQ ID NO: 36986 - protein, 258 aa, Staphylococcus aureus; identical to SEQ ID NO: 30410
  subsp. aureus CIG1213

SEQ ID NO: 36987 - protein, 165 aa, Staphylococcus aureus; identical to SEQ ID NO: 30805
  subsp. aureus CIG1213

SEQ ID NO: 36988 - protein, 131 aa, Staphylococcus aureus; identical to SEQ ID NO: 30867
  subsp. aureus CIG1213

SEQ ID NO: 36989 - protein, 242 aa, Staphylococcus aureus; identical to SEQ ID NO: 30399
  subsp. aureus CIG1213

SEQ ID NO: 36990 - protein, 239 aa, Staphylococcus aureus; identical to SEQ ID NO: 30622
  subsp. aureus CIG1213

SEQ ID NO: 36991 - protein, 254 aa, Staphylococcus aureus; identical to SEQ ID NO: 30809
  subsp. aureus CIG1213

SEQ ID NO: 36992 - protein, 274 aa, Staphylococcus aureus; identical to SEQ ID NO: 30815
  subsp. aureus CIG1213

SEQ ID NO: 36993 - protein, 338 aa, Staphylococcus aureus; identical to SEQ ID NO: 30627
  subsp. aureus CIG1213

SEQ ID NO: 36994 - protein, 351 aa, Staphylococcus aureus; identical to SEQ ID NO: 30628
  subsp. aureus CIG1213

SEQ ID NO: 36995 - protein, 44 aa, Staphylococcus aureus; identical to SEQ ID NO: 30513
  subsp. aureus CIG1213

SEQ ID NO: 36996 - protein, 2481 aa, Staphylococcus aureus; identical to SEQ ID NO: 36685
  subsp. aureus CIG1213

SEQ ID NO: 36997 - protein, 231 aa, Staphylococcus aureus; identical to SEQ ID NO: 30630
  subsp. aureus CIG1213

SEQ ID NO: 36998 - protein, 809 aa, Staphylococcus aureus; identical to SEQ ID NO: 30632
  subsp. aureus CIG1213

SEQ ID NO: 36999 - protein, 141 aa, Staphylococcus aureus; identical to SEQ ID NO: 30633
  subsp. aureus CIG1213

SEQ ID NO: 37000 - protein, 1351 aa, Staphylococcus aureus; identical to SEQ ID NO: 31203
  subsp. aureus CIG1214

SEQ ID NO: 37001 - protein, 681 aa, Staphylococcus aureus
  subsp. aureus CIG1214
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHSGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDCLVSVISSQHPFNQAYTNATDKIQKGIWQVTPTKHDWDHVDFVGQDSSDTVRTREELQDFWHHLADDLVKTEKVTDTKQA

SEQ ID NO: 37002 - protein, 745 aa, Staphylococcus aureus
  subsp. aureus CIG1214
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSIRVKKYGTTKTIKMVRDQKKSV

SEQ ID NO: 37003 - protein, 808 aa, Staphylococcus aureus; identical to SEQ ID NO: 31215
  subsp. aureus CIG1214

SEQ ID NO: 37004 - protein, 141 aa, Staphylococcus aureus; identical to SEQ ID NO: 31214
  subsp. aureus CIG1214

SEQ ID NO: 37005 - protein, 309 aa, Staphylococcus aureus; identical to SEQ ID NO: 33946
  subsp. aureus CIG1214

SEQ ID NO: 37006 - protein, 315 aa, Staphylococcus aureus; identical to SEQ ID NO: 31191
  subsp. aureus CIG1214

SEQ ID NO: 37007 - protein, 325 aa, Staphylococcus aureus; identical to SEQ ID NO: 30479
  subsp. aureus CIG1214

SEQ ID NO: 37008 - protein, 942 aa, Staphylococcus aureus; identical to SEQ ID NO: 35550
  subsp. aureus CIG1214

SEQ ID NO: 37009 - protein, 233 aa, Staphylococcus aureus; identical to SEQ ID NO: 31039
  subsp. aureus CIG1214

SEQ ID NO: 37010 - protein, 873 aa, Staphylococcus aureus; identical to SEQ ID NO: 31205
  subsp. aureus CIG1214

SEQ ID NO: 37011 - protein, 516 aa, Staphylococcus aureus; identical to SEQ ID NO: 31270
  subsp. aureus CIG1214

SEQ ID NO: 37012 - protein, 221 aa, Staphylococcus aureus; identical to SEQ ID NO: 31036
  subsp. aureus CIG1214

SEQ ID NO: 37013 - protein, 691 aa, Staphylococcus aureus; identical to SEQ ID NO: 31040
  subsp. aureus CIG1214

SEQ ID NO: 37014 - protein, 44 aa, Staphylococcus aureus; identical to SEQ ID NO: 30513
  subsp. aureus CIG1214

SEQ ID NO: 37015 - protein, 234 aa, Staphylococcus aureus; identical to SEQ ID NO: 30530
  subsp. aureus CIG1214

SEQ ID NO: 37016 - protein, 351 aa, Staphylococcus aureus; identical to SEQ ID NO: 31218
  subsp. aureus CIG1214

SEQ ID NO: 37017 - protein, 339 aa, Staphylococcus aureus; identical to SEQ ID NO: 31219
  subsp. aureus CIG1214

SEQ ID NO: 37018 - protein, 274 aa, Staphylococcus aureus; identical to SEQ ID NO: 35568
  subsp. aureus CIG1214

SEQ ID NO: 37019 - protein, 226 aa, Staphylococcus aureus; identical to SEQ ID NO: 31265
  subsp. aureus CIG1214

SEQ ID NO: 37020 - protein, 233 aa, Staphylococcus aureus; identical to SEQ ID NO: 31264
  subsp. aureus CIG1214

SEQ ID NO: 37021 - protein, 343 aa, Staphylococcus aureus; identical to SEQ ID NO: 31263
  subsp. aureus CIG1214

SEQ ID NO: 37022 - protein, 306 aa, Staphylococcus aureus; identical to SEQ ID NO: 31262
  subsp. aureus CIG1214

SEQ ID NO: 37023 - protein, 234 aa, Staphylococcus aureus; identical to SEQ ID NO: 30567
  subsp. aureus CIG1214

SEQ ID NO: 37024 - protein, 231 aa, Staphylococcus aureus; identical to SEQ ID NO: 30566
  subsp. aureus CIG1214

SEQ ID NO: 37025 - protein, 232 aa, Staphylococcus aureus; identical to SEQ ID NO: 30565
  subsp. aureus CIG1214

SEQ ID NO: 37026 - protein, 227 aa, Staphylococcus aureus; identical to SEQ ID NO: 30564
  subsp. aureus CIG1214

SEQ ID NO: 37027 - protein, 232 aa, Staphylococcus aureus; identical to SEQ ID NO: 31257
  subsp. aureus CIG1214

SEQ ID NO: 37028 - protein, 924 aa, Staphylococcus aureus
  subsp. aureus CIG1214
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSESDSDSDSDSDSESDSDSDSDSDSDSDSDSDSDSDSESDSDSDSDSESDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 37029 - protein, 1374 aa, Staphylococcus aureus; identical to SEQ ID NO: 36154
  subsp. aureus CIG1214

SEQ ID NO: 37030 - protein, 1137 aa, Staphylococcus aureus; identical to SEQ ID NO: 31254
  subsp. aureus CIG1214

SEQ ID NO: 37031 - protein, 434 aa, Staphylococcus aureus [sequence omitted]

SEQ ID NO: 37032 - protein, 1029 aa, Staphylococcus aureus; identical to SEQ ID NO: 31250
  subsp. aureus CIG1214

SEQ ID NO: 37033 - protein, 257 aa, Staphylococcus aureus; identical to SEQ ID NO: 31220
  subsp. aureus CIG1214

SEQ ID NO: 37034 - protein, 689 aa, Staphylococcus aureus; identical to SEQ ID NO: 31224
  subsp. aureus CIG1214

SEQ ID NO: 37035 - protein, 652 aa, Staphylococcus aureus; identical to SEQ ID NO: 34746
  subsp. aureus CIG1214

SEQ ID NO: 37036 - protein, 354 aa, Staphylococcus aureus; identical to SEQ ID NO: 30412
  subsp. aureus CIG1214

SEQ ID NO: 37037 - protein, 105 aa, Staphylococcus aureus; identical to SEQ ID NO: 31168
  subsp. aureus CIG1214

SEQ ID NO: 37038 - protein, 165 aa, Staphylococcus aureus; identical to SEQ ID NO: 31241
  subsp. aureus CIG1214

SEQ ID NO: 37039 - protein, 206 aa, Staphylococcus aureus; identical to SEQ ID NO: 34750
  subsp. aureus CIG1214

SEQ ID NO: 37040 - protein, 112 aa, Staphylococcus aureus; identical to SEQ ID NO: 34751
  subsp. aureus CIG1214

SEQ ID NO: 37041 - protein, 238 aa, Staphylococcus aureus; identical to SEQ ID NO: 31240
  subsp. aureus CIG1214

SEQ ID NO: 37042 - protein, 241 aa, Staphylococcus aureus; identical to SEQ ID NO: 31239
  subsp. aureus CIG1214

SEQ ID NO: 37043 - protein, 241 aa, Staphylococcus aureus; identical to SEQ ID NO: 31238
  subsp. aureus CIG1214

SEQ ID NO: 37044 - protein, 372 aa, Staphylococcus aureus; identical to SEQ ID NO: 33950
  subsp. aureus CIG1214

SEQ ID NO: 37045 - protein, 62 aa, Staphylococcus aureus; identical to SEQ ID NO: 31886
  subsp. aureus CIG1214

SEQ ID NO: 37046 - protein, 167 aa, Staphylococcus aureus; identical to SEQ ID NO: 31885
  subsp. aureus CIG1214

SEQ ID NO: 37047 - protein, 270 aa, Staphylococcus aureus; identical to SEQ ID NO: 35140
  subsp. aureus CIG1214

SEQ ID NO: 37048 - protein, 278 aa, Staphylococcus aureus; identical to SEQ ID NO: 34714
  subsp. aureus CIG1214

SEQ ID NO: 37049 - protein, 2189 aa, Staphylococcus aureus
  subsp. aureus CIG1214
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNATTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMVDEDATLNDIKKDTQLIIDEILAIKLPAEVIKASPKVGQPAPKVCTPIKKEDKQEVRKVVKELPNTGSEEMDLPLKELALITGAALLARRRSKKEKES

SEQ ID NO: 37050 - protein, 331 aa, Staphylococcus aureus; identical to SEQ ID NO: 31235
  subsp. aureus CIG1214

SEQ ID NO: 37051 - protein, 806 aa, Staphylococcus aureus; identical to SEQ ID NO: 31234
  subsp. aureus CIG1214

SEQ ID NO: 37052 - protein, 258 aa, Staphylococcus aureus; identical to SEQ ID NO: 30518
  subsp. aureus CIG1214

SEQ ID NO: 37053 - protein, 251 aa, Staphylococcus aureus; identical to SEQ ID NO: 30505
  subsp. aureus CIG1214

SEQ ID NO: 37054 - protein, 243 aa, Staphylococcus aureus; identical to SEQ ID NO: 33974
  subsp. aureus CIG1214

SEQ ID NO: 37055 - protein, 242 aa, Staphylococcus aureus; identical to SEQ ID NO: 30522
  subsp. aureus CIG1214

SEQ ID NO: 37056 - protein, 239 aa, Staphylococcus aureus; identical to SEQ ID NO: 30171
  subsp. aureus CIG1214

SEQ ID NO: 37057 - protein, 254 aa, Staphylococcus aureus; identical to SEQ ID NO: 31226
  subsp. aureus CIG1214

SEQ ID NO: 37058 - protein, 231 aa, Staphylococcus aureus; identical to SEQ ID NO: 31216
  subsp. aureus CIG1214

SEQ ID NO: 37059 - protein, 808 aa, Staphylococcus aureus; identical to SEQ ID NO: 31215
  subsp. aureus CIG1233

SEQ ID NO: 37060 - protein, 141 aa, Staphylococcus aureus; identical to SEQ ID NO: 31214
  subsp. aureus CIG1233

SEQ ID NO: 37061 - protein, 309 aa, Staphylococcus aureus; identical to SEQ ID NO: 33946
  subsp. aureus CIG1233

SEQ ID NO: 37062 - protein, 315 aa, Staphylococcus aureus; identical to SEQ ID NO: 31191
  subsp. aureus CIG1233

SEQ ID NO: 37063 - protein, 325 aa, Staphylococcus aureus; identical to SEQ ID NO: 30479
  subsp. aureus CIG1233

SEQ ID NO: 37064 - protein, 942 aa, Staphylococcus aureus; identical to SEQ ID NO: 35550
  subsp. aureus CIG1233

SEQ ID NO: 37065 - protein, 233 aa, Staphylococcus aureus; identical to SEQ ID NO: 31039
  subsp. aureus CIG1233

SEQ ID NO: 37066 - protein, 873 aa, Staphylococcus aureus; identical to SEQ ID NO: 31205
  subsp. aureus CIG1233

SEQ ID NO: 37067 - protein, 1351 aa, Staphylococcus aureus; identical to SEQ ID NO: 31203
  subsp. aureus CIG1233

SEQ ID NO: 37068 - protein, 681 aa, Staphylococcus aureus; identical to SEQ ID NO: 34710
  subsp. aureus CIG1233

SEQ ID NO: 37069 - protein, 809 aa, Staphylococcus aureus; identical to SEQ ID NO: 36878
  subsp. aureus CIG1233

SEQ ID NO: 37070 - protein, 500 aa, Staphylococcus aureus
  subsp. aureus CIG1233
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 37071 - protein, 221 aa, Staphylococcus aureus; identical to SEQ ID NO: 31036
  subsp. aureus CIG1233

SEQ ID NO: 37072 - protein, 691 aa, Staphylococcus aureus; identical to SEQ ID NO: 31040
  subsp. aureus CIG1233

SEQ ID NO: 37073 - protein, 226 aa, Staphylococcus aureus; identical to SEQ ID NO: 31265
  subsp. aureus CIG1233

SEQ ID NO: 37074 - protein, 233 aa, Staphylococcus aureus; identical to SEQ ID NO: 31264
  subsp. aureus CIG1233

SEQ ID NO: 37075 - protein, 343 aa, Staphylococcus aureus; identical to SEQ ID NO: 31263
  subsp. aureus CIG1233

SEQ ID NO: 37076 - protein, 306 aa, Staphylococcus aureus; identical to SEQ ID NO: 31262
  subsp. aureus CIG1233

SEQ ID NO: 37077 - protein, 234 aa, Staphylococcus aureus; identical to SEQ ID NO: 30567
  subsp. aureus CIG1233

SEQ ID NO: 37078 - protein, 231 aa, Staphylococcus aureus; identical to SEQ ID NO: 30566
  subsp. aureus CIG1233

SEQ ID NO: 37079 - protein, 232 aa, Staphylococcus aureus; identical to SEQ ID NO: 30565
  subsp. aureus CIG1233

SEQ ID NO: 37080 - protein, 227 aa, Staphylococcus aureus; identical to SEQ ID NO: 30564
  subsp. aureus CIG1233

SEQ ID NO: 37081 - protein, 232 aa, Staphylococcus aureus; identical to SEQ ID NO: 31257
  subsp. aureus CIG1233

SEQ ID NO: 37082 - protein, 924 aa, Staphylococcus aureus; identical to SEQ ID NO: 34735
  subsp. aureus CIG1233

SEQ ID NO: 37083 - protein, 1374 aa, Staphylococcus aureus; identical to SEQ ID NO: 36154
  subsp. aureus CIG1233

SEQ ID NO: 37084 - protein, 1137 aa, Staphylococcus aureus; identical to SEQ ID NO: 31254
  subsp. aureus CIG1233

SEQ ID NO: 37085 - protein, 434 aa, Staphylococcus aureus [sequence omitted]

SEQ ID NO: 37086 - protein, 1029 aa, Staphylococcus aureus; identical to SEQ ID NO: 31250
  subsp. aureus CIG1233

SEQ ID NO: 37087 - protein, 652 aa, Staphylococcus aureus; identical to SEQ ID NO: 34746
  subsp. aureus CIG1233

SEQ ID NO: 37088 - protein, 354 aa, Staphylococcus aureus; identical to SEQ ID NO: 30412
  subsp. aureus CIG1233

SEQ ID NO: 37089 - protein, 105 aa, Staphylococcus aureus; identical to SEQ ID NO: 31168
  subsp. aureus CIG1233

SEQ ID NO: 37090 - protein, 165 aa, Staphylococcus aureus; identical to SEQ ID NO: 31241
  subsp. aureus CIG1233

SEQ ID NO: 37091 - protein, 206 aa, Staphylococcus aureus; identical to SEQ ID NO: 34750
  subsp. aureus CIG1233

SEQ ID NO: 37092 - protein, 112 aa, Staphylococcus aureus; identical to SEQ ID NO: 34751
  subsp. aureus CIG1233

SEQ ID NO: 37093 - protein, 238 aa, Staphylococcus aureus; identical to SEQ ID NO: 31240
  subsp. aureus CIG1233

SEQ ID NO: 37094 - protein, 241 aa, Staphylococcus aureus; identical to SEQ ID NO: 31239
  subsp. aureus CIG1233

SEQ ID NO: 37095 - protein, 241 aa, Staphylococcus aureus
  subsp. aureus CIG1233
MKKNITNKIVLSTALLLLGTTSTQPPKAPISFSSEAKAYNISENETNINELIKYYTQPHLSFSGKWLWQNPNGTIHATLQTWVWYTHIQVLGPESWGNINQLRDKYVDIFGTKDEDTIEGYWTYDETFTGGVTPAATSSDKPYKLFLKYKDKQQTMIGGLEFYQGNKPVITLKELDFRVRQTLIKNKKLYNGEFNKGQIRITGGGNHYTIDLSKKLKLTDTNSYVKNPRHAEIEVILEKSH

SEQ ID NO: 37096 - protein, 372 aa, Staphylococcus aureus; identical to SEQ ID NO: 33950
  subsp. aureus CIG1233

SEQ ID NO: 37097 - protein, 62 aa, Staphylococcus aureus; identical to SEQ ID NO: 31886
  subsp. aureus CIG1233

SEQ ID NO: 37098 - protein, 167 aa, Staphylococcus aureus; identical to SEQ ID NO: 31885
  subsp. aureus CIG1233

SEQ ID NO: 37099 - protein, 270 aa, Staphylococcus aureus; identical to SEQ ID NO: 35140
  subsp. aureus CIG1233

SEQ ID NO: 37100 - protein, 278 aa, Staphylococcus aureus; identical to SEQ ID NO: 34714
  subsp. aureus CIG1233

SEQ ID NO: 37101 - protein, 2189 aa, Staphylococcus aureus; identical to SEQ ID NO: 31236
  subsp. aureus CIG1233

SEQ ID NO: 37102 - protein, 331 aa, Staphylococcus aureus; identical to SEQ ID NO: 31235
  subsp. aureus CIG1233

SEQ ID NO: 37103 - protein, 806 aa, Staphylococcus aureus; identical to SEQ ID NO: 31234
  subsp. aureus CIG1233

SEQ ID NO: 37104 - protein, 258 aa, Staphylococcus aureus; identical to SEQ ID NO: 30518
  subsp. aureus CIG1233

SEQ ID NO: 37105 - protein, 251 aa, Staphylococcus aureus; identical to SEQ ID NO: 30505
  subsp. aureus CIG1233

SEQ ID NO: 37106 - protein, 261 aa, Staphylococcus aureus
  subsp. aureus CIG1233
MKLFAFIFICVKSCSLLFMLNGNPKPEQLNKASEFTGLMDNMRYLYDDKHVSEINIKAQEKFLQHDLLFKINGSKIDGSKILKTEFNNNSLSDKYKNKNIDLFGTNYYYQCYFSADNMELNDGRLIEKTCMYGGVTEHDGNQIDKNNSTDNSRNILIKVFENERNSLSFDIPTNKKNITAQEIDYKVRNYLLKHKNLYEFNSSPYETGYIKFIEGNGHSFWYDMMPESGEKFYPTKYLLIYNDNKTVESKSINVEVHLTKK

SEQ ID NO: 37107 - protein, 242 aa, Staphylococcus aureus; identical to SEQ ID NO: 30522
  subsp. aureus CIG1233

SEQ ID NO: 37108 - protein, 239 aa, Staphylococcus aureus; identical to SEQ ID NO: 30171
  subsp. aureus CIG1233

SEQ ID NO: 37109 - protein, 254 aa, Staphylococcus aureus; identical to SEQ ID NO: 31226
  subsp. aureus CIG1233

SEQ ID NO: 37110 - protein, 689 aa, Staphylococcus aureus; identical to SEQ ID NO: 31224
  subsp. aureus CIG1233

SEQ ID NO: 37111 - protein, 231 aa, Staphylococcus aureus; identical to SEQ ID NO: 36931
  subsp. aureus CIG1233

SEQ ID NO: 37112 - protein, 339 aa, Staphylococcus aureus; identical to SEQ ID NO: 31219
  subsp. aureus CIG1233

SEQ ID NO: 37113 - protein, 351 aa, Staphylococcus aureus; identical to SEQ ID NO: 31218
  subsp. aureus CIG1233

SEQ ID NO: 37114 - protein, 234 aa, Staphylococcus aureus; identical to SEQ ID NO: 30530
  subsp. aureus CIG1233

SEQ ID NO: 37115 - protein, 44 aa, Staphylococcus aureus; identical to SEQ ID NO: 30513
  subsp. aureus CIG1233

SEQ ID NO: 37116 - protein, 231 aa, Staphylococcus aureus; identical to SEQ ID NO: 31216
  subsp. aureus CIG1233

SEQ ID NO: 37117 - protein, 64 aa, Staphylococcus aureus
  subsp. aureus CIG1242
TSDDKVATITSGNKSTNVTVHKSEAGTSSVFYYKTGDMLPEDTTHVRWFLNINNEKDMYRKILL

SEQ ID NO: 37118 - protein, 140 aa, Staphylococcus aureus
  subsp. aureus CIG1242
MQLLILKKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGI

SEQ ID NO: 37119 - protein, 516 aa, Staphylococcus aureus; identical to SEQ ID NO: 31270
  subsp. aureus CIG1242

SEQ ID NO: 37120 - protein, 221 aa, Staphylococcus aureus; identical to SEQ ID NO: 31036
  subsp. aureus CIG1242

SEQ ID NO: 37121 - protein, 691 aa, Staphylococcus aureus; identical to SEQ ID NO: 31040
  subsp. aureus CIG1242

SEQ ID NO: 37122 - protein, 231 aa, Staphylococcus aureus; identical to SEQ ID NO: 30566
  subsp. aureus CIG1242

SEQ ID NO: 37123 - protein, 232 aa, Staphylococcus aureus; identical to SEQ ID NO: 30565
  subsp. aureus CIG1242

SEQ ID NO: 37124 - protein, 227 aa, Staphylococcus aureus; identical to SEQ ID NO: 30564
  subsp. aureus CIG1242

SEQ ID NO: 37125 - protein, 226 aa, Staphylococcus aureus; identical to SEQ ID NO: 31265
  subsp. aureus CIG1242

SEQ ID NO: 37126 - protein, 233 aa, Staphylococcus aureus; identical to SEQ ID NO: 31264
  subsp. aureus CIG1242

SEQ ID NO: 37127 - protein, 343 aa, Staphylococcus aureus; identical to SEQ ID NO: 31263
  subsp. aureus CIG1242

SEQ ID NO: 37128 - protein, 306 aa, Staphylococcus aureus; identical to SEQ ID NO: 31262
  subsp. aureus CIG1242

SEQ ID NO: 37129 - protein, 234 aa, Staphylococcus aureus; identical to SEQ ID NO: 30567
  subsp. aureus CIG1242

SEQ ID NO: 37130 - protein, 232 aa, Staphylococcus aureus; identical to SEQ ID NO: 31257
  subsp. aureus CIG1242

SEQ ID NO: 37131 - protein, 434 aa, Staphylococcus aureus [sequence omitted]

SEQ ID NO: 37132 - protein, 1025 aa, Staphylococcus aureus
  subsp. aureus CIG1242
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 37133 - protein, 924 aa, Staphylococcus aureus; identical to SEQ ID NO: 34735
  subsp. aureus CIG1242

SEQ ID NO: 37134 - protein, 1374 aa, Staphylococcus aureus; identical to SEQ ID NO: 36154
  subsp. aureus CIG1242

SEQ ID NO: 37135 - protein, 1131 aa, Staphylococcus aureus
  subsp. aureus CIG1242
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 37136 - protein, 62 aa, Staphylococcus aureus; identical to SEQ ID NO: 31886
  subsp. aureus CIG1242

SEQ ID NO: 37137 - protein, 166 aa, Staphylococcus aureus
  subsp. aureus CIG1242
MGEFEVKYLTGFILILLLEGIFTNSASAIEYSDLHHKSKLDSKRLYNAKVSFANPTDLENKTNDRLLKHDLLFHDMFLNDAWKKDLKVEFENEALSKKFINKNIDVYAGSYSYECHGGETNKTQCSYGGVTLSDNNKYDDYKNIPCNLWIDGHQTEIELTAVKTKK

SEQ ID NO: 37138 - protein, 270 aa, Staphylococcus aureus; identical to SEQ ID NO: 35140
  subsp. aureus CIG1242

SEQ ID NO: 37139 - protein, 652 aa, Staphylococcus aureus; identical to SEQ ID NO: 34746
  subsp. aureus CIG1242

SEQ ID NO: 37140 - protein, 354 aa, Staphylococcus aureus; identical to SEQ ID NO: 30412
  subsp. aureus CIG1242

SEQ ID NO: 37141 - protein, 105 aa, Staphylococcus aureus; identical to SEQ ID NO: 31168
  subsp. aureus CIG1242

SEQ ID NO: 37142 - protein, 165 aa, Staphylococcus aureus; identical to SEQ ID NO: 31241
  subsp. aureus CIG1242

SEQ ID NO: 37143 - protein, 206 aa, Staphylococcus aureus; identical to SEQ ID NO: 34750
  subsp. aureus CIG1242

SEQ ID NO: 37144 - protein, 112 aa, Staphylococcus aureus; identical to SEQ ID NO: 34751
  subsp. aureus CIG1242

SEQ ID NO: 37145 - protein, 238 aa, Staphylococcus aureus; identical to SEQ ID NO: 31240
  subsp. aureus CIG1242

SEQ ID NO: 37146 - protein, 241 aa, Staphylococcus aureus; identical to SEQ ID NO: 31239
  subsp. aureus CIG1242

SEQ ID NO: 37147 - protein, 241 aa, Staphylococcus aureus; identical to SEQ ID NO: 31238
  subsp. aureus CIG1242

SEQ ID NO: 37148 - protein, 372 aa, Staphylococcus aureus; identical to SEQ ID NO: 33950
  subsp. aureus CIG1242

SEQ ID NO: 37149 - protein, 278 aa, Staphylococcus aureus; identical to SEQ ID NO: 34714
  subsp. aureus CIG1242

SEQ ID NO: 37150 - protein, 2189 aa, Staphylococcus aureus; identical to SEQ ID NO: 31236
  subsp. aureus CIG1242

SEQ ID NO: 37151 - protein, 331 aa, Staphylococcus aureus; identical to SEQ ID NO: 31235
  subsp. aureus CIG1242

SEQ ID NO: 37152 - protein, 806 aa, Staphylococcus aureus; identical to SEQ ID NO: 31234
  subsp. aureus CIG1242

SEQ ID NO: 37153 - protein, 258 aa, Staphylococcus aureus; identical to SEQ ID NO: 30518
  subsp. aureus CIG1242

SEQ ID NO: 37154 - protein, 251 aa, Staphylococcus aureus; identical to SEQ ID NO: 30505
  subsp. aureus CIG1242

SEQ ID NO: 37155 - protein, 243 aa, Staphylococcus aureus; identical to SEQ ID NO: 33974
  subsp. aureus CIG1242

SEQ ID NO: 37156 - protein, 242 aa, Staphylococcus aureus; identical to SEQ ID NO: 30522
  subsp. aureus CIG1242

SEQ ID NO: 37157 - protein, 239 aa, Staphylococcus aureus; identical to SEQ ID NO: 30171
  subsp. aureus CIG1242

SEQ ID NO: 37158 - protein, 254 aa, Staphylococcus aureus; identical to SEQ ID NO: 31226
  subsp. aureus CIG1242

SEQ ID NO: 37159 - protein, 231 aa, Staphylococcus aureus; identical to SEQ ID NO: 31216
  subsp. aureus CIG1242

SEQ ID NO: 37160 - protein, 808 aa, Staphylococcus aureus; identical to SEQ ID NO: 31215
  subsp. aureus CIG1242

SEQ ID NO: 37161 - protein, 141 aa, Staphylococcus aureus; identical to SEQ ID NO: 31214
  subsp. aureus CIG1242

SEQ ID NO: 37162 - protein, 689 aa, Staphylococcus aureus; identical to SEQ ID NO: 31224
  subsp. aureus CIG1242

SEQ ID NO: 37163 - protein, 257 aa, Staphylococcus aureus; identical to SEQ ID NO: 31220
  subsp. aureus CIG1242

SEQ ID NO: 37164 - protein, 231 aa, Staphylococcus aureus; identical to SEQ ID NO: 36931
  subsp. aureus CIG1242

SEQ ID NO: 37165 - protein, 339 aa, Staphylococcus aureus; identical to SEQ ID NO: 31219
  subsp. aureus CIG1242

SEQ ID NO: 37166 - protein, 351 aa, Staphylococcus aureus; identical to SEQ ID NO: 31218
  subsp. aureus CIG1242

SEQ ID NO: 37167 - protein, 234 aa, Staphylococcus aureus; identical to SEQ ID NO: 30530
  subsp. aureus CIG1242

SEQ ID NO: 37168 - protein, 44 aa, Staphylococcus aureus; identical to SEQ ID NO: 30513
  subsp. aureus CIG1242

SEQ ID NO: 37169 - protein, 233 aa, Staphylococcus aureus; identical to SEQ ID NO: 31039
  subsp. aureus CIG1242

SEQ ID NO: 37170 - protein, 873 aa, Staphylococcus aureus
  subsp. aureus CIG1242
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSDSDSDSDSDSDSDSDSNSDSDSDSDSDSDSDSDSDSDSDSESDSDSDSDSDSDSDSDSDSDSDSDSDSDSDSDSDSESDSESDSDSDSESDSDSDPDSESDSDSDSDSDSDSESDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 37171 - protein, 1351 aa, Staphylococcus aureus; identical to SEQ ID NO: 31203
  subsp. aureus CIG1242

SEQ ID NO: 37172 - protein, 681 aa, Staphylococcus aureus
  subsp. aureus CIG1242
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKINIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHSGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 37173 - protein, 809 aa, Staphylococcus aureus; identical to SEQ ID NO: 36878
  subsp. aureus CIG1242

SEQ ID NO: 37174 - protein, 309 aa, Staphylococcus aureus; identical to SEQ ID NO: 33946
  subsp. aureus CIG1242

SEQ ID NO: 37175 - protein, 315 aa, Staphylococcus aureus; identical to SEQ ID NO: 31191
  subsp. aureus CIG1242

SEQ ID NO: 37176 - protein, 325 aa, Staphylococcus aureus; identical to SEQ ID NO: 30479
  subsp. aureus CIG1242

SEQ ID NO: 37177 - protein, 942 aa, Staphylococcus aureus; identical to SEQ ID NO: 35550
  subsp. aureus CIG1242

SEQ ID NO: 37178 - protein, 808 aa, Staphylococcus aureus; identical to SEQ ID NO: 31215
  subsp. aureus CIG1267

SEQ ID NO: 37179 - protein, 141 aa, Staphylococcus aureus; identical to SEQ ID NO: 31214
  subsp. aureus CIG1267

SEQ ID NO: 37180 - protein, 309 aa, Staphylococcus aureus; identical to SEQ ID NO: 33946
  subsp. aureus CIG1267

SEQ ID NO: 37181 - protein, 315 aa, Staphylococcus aureus; identical to SEQ ID NO: 31191
  subsp. aureus CIG1267

SEQ ID NO: 37182 - protein, 325 aa, Staphylococcus aureus; identical to SEQ ID NO: 30479
  subsp. aureus CIG1267

SEQ ID NO: 37183 - protein, 942 aa, Staphylococcus aureus; identical to SEQ ID NO: 35550
  subsp. aureus CIG1267

SEQ ID NO: 37184 - protein, 233 aa, Staphylococcus aureus; identical to SEQ ID NO: 31039
  subsp. aureus CIG1267

SEQ ID NO: 37185 - protein, 873 aa, Staphylococcus aureus; identical to SEQ ID NO: 31205
  subsp. aureus CIG1267

SEQ ID NO: 37186 - protein, 1351 aa, Staphylococcus aureus
  subsp. aureus CIG1267
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSTSGSTSTSTSESLSMSGSDSTSVSDSTSMSESDSTSVSMSQDKSDSTSISDSESVSTSTSMSLSISDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 37187 - protein, 681 aa, Staphylococcus aureus; identical to SEQ ID NO: 34710
  subsp. aureus CIG1267

SEQ ID NO: 37188 - protein, 809 aa, Staphylococcus aureus; identical to SEQ ID NO: 36878
  subsp. aureus CIG1267

SEQ ID NO: 37189 - protein, 691 aa, Staphylococcus aureus; identical to SEQ ID NO: 31040
  subsp. aureus CIG1267

SEQ ID NO: 37190 - protein, 226 aa, Staphylococcus aureus; identical to SEQ ID NO: 31265
  subsp. aureus CIG1267

SEQ ID NO: 37191 - protein, 233 aa, Staphylococcus aureus; identical to SEQ ID NO: 31264
  subsp. aureus CIG1267

SEQ ID NO: 37192 - protein, 343 aa, Staphylococcus aureus; identical to SEQ ID NO: 31263
  subsp. aureus CIG1267

SEQ ID NO: 37193 - protein, 306 aa, Staphylococcus aureus; identical to SEQ ID NO: 31262
  subsp. aureus CIG1267

SEQ ID NO: 37194 - protein, 234 aa, Staphylococcus aureus; identical to SEQ ID NO: 30567
  subsp. aureus CIG1267

SEQ ID NO: 37195 - protein, 231 aa, Staphylococcus aureus; identical to SEQ ID NO: 30566
  subsp. aureus CIG1267

SEQ ID NO: 37196 - protein, 232 aa, Staphylococcus aureus; identical to SEQ ID NO: 30565
  subsp. aureus CIG1267

SEQ ID NO: 37197 - protein, 227 aa, Staphylococcus aureus; identical to SEQ ID NO: 30564
  subsp. aureus CIG1267

SEQ ID NO: 37198 - protein, 232 aa, Staphylococcus aureus; identical to SEQ ID NO: 31257
  subsp. aureus CIG1267

SEQ ID NO: 37199 - protein, 500 aa, Staphylococcus aureus
  subsp. aureus CIG1267
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 37200 - protein, 221 aa, Staphylococcus aureus; identical to SEQ ID NO: 31036
  subsp. aureus CIG1267

SEQ ID NO: 37201 - protein, 924 aa, Staphylococcus aureus; identical to SEQ ID NO: 37028
  subsp. aureus CIG1267

SEQ ID NO: 37202 - protein, 1374 aa, Staphylococcus aureus; identical to SEQ ID NO: 36154
  subsp. aureus CIG1267

SEQ ID NO: 37203 - protein, 1137 aa, Staphylococcus aureus; identical to SEQ ID NO: 31254
  subsp. aureus CIG1267

SEQ ID NO: 37204 - protein, 434 aa, Staphylococcus aureus [sequence omitted]

SEQ ID NO: 37205 - protein, 1029 aa, Staphylococcus aureus; identical to SEQ ID NO: 31250
  subsp. aureus CIG1267

SEQ ID NO: 37206 - protein, 62 aa, Staphylococcus aureus; identical to SEQ ID NO: 31886
  subsp. aureus CIG1267

SEQ ID NO: 37207 - protein, 167 aa, Staphylococcus aureus; identical to SEQ ID NO: 31885
  subsp. aureus CIG1267

SEQ ID NO: 37208 - protein, 270 aa, Staphylococcus aureus; identical to SEQ ID NO: 35140
  subsp. aureus CIG1267

SEQ ID NO: 37209 - protein, 652 aa, Staphylococcus aureus; identical to SEQ ID NO: 34746
  subsp. aureus CIG1267

SEQ ID NO: 37210 - protein, 354 aa, Staphylococcus aureus; identical to SEQ ID NO: 30412
  subsp. aureus CIG1267

SEQ ID NO: 37211 - protein, 105 aa, Staphylococcus aureus; identical to SEQ ID NO: 31168
  subsp. aureus CIG1267

SEQ ID NO: 37212 - protein, 165 aa, Staphylococcus aureus; identical to SEQ ID NO: 31241
  subsp. aureus CIG1267

SEQ ID NO: 37213 - protein, 206 aa, Staphylococcus aureus; identical to SEQ ID NO: 34750
  subsp. aureus CIG1267

SEQ ID NO: 37214 - protein, 112 aa, Staphylococcus aureus; identical to SEQ ID NO: 34751
  subsp. aureus CIG1267

SEQ ID NO: 37215 - protein, 238 aa, Staphylococcus aureus; identical to SEQ ID NO: 31240
  subsp. aureus CIG1267

SEQ ID NO: 37216 - protein, 241 aa, Staphylococcus aureus; identical to SEQ ID NO: 31239
  subsp. aureus CIG1267

SEQ ID NO: 37217 - protein, 241 aa, Staphylococcus aureus; identical to SEQ ID NO: 31238
  subsp. aureus CIG1267

SEQ ID NO: 37218 - protein, 372 aa, Staphylococcus aureus; identical to SEQ ID NO: 33950
  subsp. aureus CIG1267

SEQ ID NO: 37219 - protein, 278 aa, Staphylococcus aureus; identical to SEQ ID NO: 34714
  subsp. aureus CIG1267

SEQ ID NO: 37220 - protein, 2189 aa, Staphylococcus aureus; identical to SEQ ID NO: 31236
  subsp. aureus CIG1267

SEQ ID NO: 37221 - protein, 331 aa, Staphylococcus aureus; identical to SEQ ID NO: 31235
  subsp. aureus CIG1267

SEQ ID NO: 37222 - protein, 806 aa, Staphylococcus aureus; identical to SEQ ID NO: 31234
  subsp. aureus CIG1267

SEQ ID NO: 37223 - protein, 258 aa, Staphylococcus aureus; identical to SEQ ID NO: 30518
  subsp. aureus CIG1267

SEQ ID NO: 37224 - protein, 251 aa, Staphylococcus aureus; identical to SEQ ID NO: 30505
  subsp. aureus CIG1267

SEQ ID NO: 37225 - protein, 261 aa, Staphylococcus aureus; identical to SEQ ID NO: 30506
  subsp. aureus CIG1267

SEQ ID NO: 37226 - protein, 242 aa, Staphylococcus aureus; identical to SEQ ID NO: 30522
  subsp. aureus CIG1267

SEQ ID NO: 37227 - protein, 239 aa, Staphylococcus aureus; identical to SEQ ID NO: 30171
  subsp. aureus CIG1267

SEQ ID NO: 37228 - protein, 254 aa, Staphylococcus aureus; identical to SEQ ID NO: 31226
  subsp. aureus CIG1267

SEQ ID NO: 37229 - protein, 689 aa, Staphylococcus aureus; identical to SEQ ID NO: 31224
  subsp. aureus CIG1267

SEQ ID NO: 37230 - protein, 257 aa, Staphylococcus aureus; identical to SEQ ID NO: 31220
  subsp. aureus CIG1267

SEQ ID NO: 37231 - protein, 274 aa, Staphylococcus aureus; identical to SEQ ID NO: 35568
  subsp. aureus CIG1267

SEQ ID NO: 37232 - protein, 339 aa, Staphylococcus aureus; identical to SEQ ID NO: 31219
  subsp. aureus CIG1267

SEQ ID NO: 37233 - protein, 351 aa, Staphylococcus aureus; identical to SEQ ID NO: 31218
  subsp. aureus CIG1267

SEQ ID NO: 37234 - protein, 234 aa, Staphylococcus aureus; identical to SEQ ID NO: 30530
  subsp. aureus CIG1267

SEQ ID NO: 37235 - protein, 44 aa, Staphylococcus aureus; identical to SEQ ID NO: 30513
  subsp. aureus CIG1267

SEQ ID NO: 37236 - protein, 231 aa, Staphylococcus aureus; identical to SEQ ID NO: 31216
  subsp. aureus CIG1267

SEQ ID NO: 37237 - protein, 808 aa, Staphylococcus aureus; identical to SEQ ID NO: 31215
  subsp. aureus CIG149

SEQ ID NO: 37238 - protein, 141 aa, Staphylococcus aureus; identical to SEQ ID NO: 31214
  subsp. aureus CIG149

SEQ ID NO: 37239 - protein, 309 aa, Staphylococcus aureus; identical to SEQ ID NO: 33946
  subsp. aureus CIG149

SEQ ID NO: 37240 - protein, 315 aa, Staphylococcus aureus; identical to SEQ ID NO: 31191
  subsp. aureus CIG149

SEQ ID NO: 37241 - protein, 325 aa, Staphylococcus aureus; identical to SEQ ID NO: 30479
  subsp. aureus CIG149

SEQ ID NO: 37242 - protein, 942 aa, Staphylococcus aureus; identical to SEQ ID NO: 35550
  subsp. aureus CIG149

SEQ ID NO: 37243 - protein, 233 aa, Staphylococcus aureus; identical to SEQ ID NO: 31039
  subsp. aureus CIG149

SEQ ID NO: 37244 - protein, 887 aa, Staphylococcus aureus
  subsp. aureus CIG149
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSDSDSDSDSDSDSDSDSNSDSDSDSDSDSDSDSDSDSDSDSESDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 37245 - protein, 1351 aa, Staphylococcus aureus; identical to SEQ ID NO: 31203
  subsp. aureus CIG149

SEQ ID NO: 37246 - protein, 681 aa, Staphylococcus aureus; identical to SEQ ID NO: 34710
  subsp. aureus CIG149

SEQ ID NO: 37247 - protein, 809 aa, Staphylococcus aureus; identical to SEQ ID NO: 36878
  subsp. aureus CIG149

SEQ ID NO: 37248 - protein, 516 aa, Staphylococcus aureus; identical to SEQ ID NO: 31270
  subsp. aureus CIG149

SEQ ID NO: 37249 - protein, 221 aa, Staphylococcus aureus; identical to SEQ ID NO: 31036
  subsp. aureus CIG149

SEQ ID NO: 37250 - protein, 44 aa, Staphylococcus aureus; identical to SEQ ID NO: 30513
  subsp. aureus CIG149

SEQ ID NO: 37251 - protein, 691 aa, Staphylococcus aureus; identical to SEQ ID NO: 31040
  subsp. aureus CIG149

SEQ ID NO: 37252 - protein, 226 aa, Staphylococcus aureus; identical to SEQ ID NO: 31265
  subsp. aureus CIG149

SEQ ID NO: 37253 - protein, 233 aa, Staphylococcus aureus; identical to SEQ ID NO: 31264
  subsp. aureus CIG149

SEQ ID NO: 37254 - protein, 343 aa, Staphylococcus aureus; identical to SEQ ID NO: 31263
  subsp. aureus CIG149

SEQ ID NO: 37255 - protein, 306 aa, Staphylococcus aureus; identical to SEQ ID NO: 31262
  subsp. aureus CIG149

SEQ ID NO: 37256 - protein, 234 aa, Staphylococcus aureus; identical to SEQ ID NO: 30567
  subsp. aureus CIG149

SEQ ID NO: 37257 - protein, 231 aa, Staphylococcus aureus; identical to SEQ ID NO: 30566
  subsp. aureus CIG149

SEQ ID NO: 37258 - protein, 232 aa, Staphylococcus aureus; identical to SEQ ID NO: 30565
  subsp. aureus CIG149

SEQ ID NO: 37259 - protein, 227 aa, Staphylococcus aureus; identical to SEQ ID NO: 30564
  subsp. aureus CIG149

SEQ ID NO: 37260 - protein, 234 aa, Staphylococcus aureus; identical to SEQ ID NO: 30530
  subsp. aureus CIG149

SEQ ID NO: 37261 - protein, 351 aa, Staphylococcus aureus; identical to SEQ ID NO: 31218
  subsp. aureus CIG149

SEQ ID NO: 37262 - protein, 339 aa, Staphylococcus aureus; identical to SEQ ID NO: 31219
  subsp. aureus CIG149

SEQ ID NO: 37263 - protein, 231 aa, Staphylococcus aureus; identical to SEQ ID NO: 36931
  subsp. aureus CIG149

SEQ ID NO: 37264 - protein, 122 aa, Staphylococcus aureus
  subsp. aureus CIG149
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKK

SEQ ID NO: 37265 - protein, 763 aa, Staphylococcus aureus
  subsp. aureus CIG149
MAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSESDSDSDSDSDSDSDSDSDSDSDSDSDSDSDSDSDSESDSDSDSDSESDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 37266 - protein, 1374 aa, Staphylococcus aureus; identical to SEQ ID NO: 36154
  subsp. aureus CIG149

SEQ ID NO: 37267 - protein, 1137 aa, Staphylococcus aureus; identical to SEQ ID NO: 31254
  subsp. aureus CIG149

SEQ ID NO: 37268 - protein, 434 aa, Staphylococcus aureus [sequence omitted]

SEQ ID NO: 37269 - protein, 1023 aa, Staphylococcus aureus
  subsp. aureus CIG149
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 37270 - protein, 652 aa, Staphylococcus aureus; identical to SEQ ID NO: 34746
  subsp. aureus CIG149

SEQ ID NO: 37271 - protein, 354 aa, Staphylococcus aureus
  subsp. aureus CIG149
MTKHYLNSKYQSEQRSSAMKKITMGTASIILGSLVYIGADSQQVNAATEATNATNNQSTQVSQATSQPINFQVQKDGSSEKSNMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPAVTAPSKNENRQTTKVVSSEATKDQSQTQSARTVKTTQTAQDQNKVQTPVKDVATAKSESNNQAVSDNKSQQTNKVTKQNEVHKQGPSKDSKAKELPKTGLTSVDNFISTVAFATLALLGSLSLLLFKRKESK

SEQ ID NO: 37272 - protein, 105 aa, Staphylococcus aureus; identical to SEQ ID NO: 31168
  subsp. aureus CIG149

SEQ ID NO: 37273 - protein, 165 aa, Staphylococcus aureus; identical to SEQ ID NO: 31241
  subsp. aureus CIG149

SEQ ID NO: 37274 - protein, 206 aa, Staphylococcus aureus; identical to SEQ ID NO: 34750
  subsp. aureus CIG149

SEQ ID NO: 37275 - protein, 112 aa, Staphylococcus aureus; identical to SEQ ID NO: 34751
  subsp. aureus CIG149

SEQ ID NO: 37276 - protein, 238 aa, Staphylococcus aureus; identical to SEQ ID NO: 31240
  subsp. aureus CIG149

SEQ ID NO: 37277 - protein, 241 aa, Staphylococcus aureus; identical to SEQ ID NO: 31239
  subsp. aureus CIG149

SEQ ID NO: 37278 - protein, 241 aa, Staphylococcus aureus; identical to SEQ ID NO: 31238
  subsp. aureus CIG149

SEQ ID NO: 37279 - protein, 372 aa, Staphylococcus aureus; identical to SEQ ID NO: 33950
  subsp. aureus CIG149

SEQ ID NO: 37280 - protein, 62 aa, Staphylococcus aureus; identical to SEQ ID NO: 31886
  subsp. aureus CIG149

SEQ ID NO: 37281 - protein, 167 aa, Staphylococcus aureus; identical to SEQ ID NO: 31885
  subsp. aureus CIG149

SEQ ID NO: 37282 - protein, 270 aa, Staphylococcus aureus; identical to SEQ ID NO: 35140
  subsp. aureus CIG149

SEQ ID NO: 37283 - protein, 278 aa, Staphylococcus aureus; identical to SEQ ID NO: 34714
  subsp. aureus CIG149

SEQ ID NO: 37284 - protein, 2189 aa, Staphylococcus aureus; identical to SEQ ID NO: 31236
  subsp. aureus CIG149

SEQ ID NO: 37285 - protein, 331 aa, Staphylococcus aureus; identical to SEQ ID NO: 31235
  subsp. aureus CIG149

SEQ ID NO: 37286 - protein, 806 aa, Staphylococcus aureus; identical to SEQ ID NO: 31234
  subsp. aureus CIG149

SEQ ID NO: 37287 - protein, 232 aa, Staphylococcus aureus; identical to SEQ ID NO: 31257
  subsp. aureus CIG149

SEQ ID NO: 37288 - protein, 258 aa, Staphylococcus aureus; identical to SEQ ID NO: 30518
  subsp. aureus CIG149

SEQ ID NO: 37289 - protein, 251 aa, Staphylococcus aureus; identical to SEQ ID NO: 30505
  subsp. aureus CIG149

SEQ ID NO: 37290 - protein, 261 aa, Staphylococcus aureus; identical to SEQ ID NO: 30506
  subsp. aureus CIG149

SEQ ID NO: 37291 - protein, 242 aa, Staphylococcus aureus; identical to SEQ ID NO: 30522
  subsp. aureus CIG149

SEQ ID NO: 37292 - protein, 239 aa, Staphylococcus aureus; identical to SEQ ID NO: 30171
  subsp. aureus CIG149

SEQ ID NO: 37293 - protein, 254 aa, Staphylococcus aureus; identical to SEQ ID NO: 31226
  subsp. aureus CIG149

SEQ ID NO: 37294 - protein, 689 aa, Staphylococcus aureus; identical to SEQ ID NO: 31224
  subsp. aureus CIG149

SEQ ID NO: 37295 - protein, 257 aa, Staphylococcus aureus; identical to SEQ ID NO: 31220
  subsp. aureus CIG149

SEQ ID NO: 37296 - protein, 231 aa, Staphylococcus aureus; identical to SEQ ID NO: 31216
  subsp. aureus CIG149

SEQ ID NO: 37297 - protein, 808 aa, Staphylococcus aureus; identical to SEQ ID NO: 31215
  subsp. aureus CIG1500

SEQ ID NO: 37298 - protein, 141 aa, Staphylococcus aureus; identical to SEQ ID NO: 31214
  subsp. aureus CIG1500

SEQ ID NO: 37299 - protein, 100 aa, Staphylococcus aureus
  subsp. aureus CIG1500
MIKNKILTATLAVGLIAPLANPFIEISKAENKIEDIGQGAEIIKRTQDITSKRLAITQNIQFDFVKDKKYNKDALVVKMQGFISSRTTYSDLKNIHILKE

SEQ ID NO: 37300 - protein, 209 aa, Staphylococcus aureus
  subsp. aureus CIG1500
MIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHEKGKGDKSEFEITYGRNMDATYAYVTRHRLAVDRKHDAFKNRNVTVKYEVNWKTHEVKIKSITPK

SEQ ID NO: 37301 - protein, 315 aa, Staphylococcus aureus; identical to SEQ ID NO: 31191
  subsp. aureus CIG1500

SEQ ID NO: 37302 - protein, 323 aa, Staphylococcus aureus
  subsp. aureus CIG1500
MNKLVKSSVATSMALLLLSNTANAEGKITPVSVKKVDDKVTLYKTTATADSDKFKISQILTFNFIKDKSYDKDTLVLKAAGNINSGYERPNPKDYDFSKIYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 37303 - protein, 942 aa, Staphylococcus aureus; identical to SEQ ID NO: 35550
  subsp. aureus CIG1500

SEQ ID NO: 37304 - protein, 233 aa, Staphylococcus aureus; identical to SEQ ID NO: 31039
  subsp. aureus CIG1500

SEQ ID NO: 37305 - protein, 873 aa, Staphylococcus aureus; identical to SEQ ID NO: 31205
  subsp. aureus CIG1500

SEQ ID NO: 37306 - protein, 1351 aa, Staphylococcus aureus; identical to SEQ ID NO: 31203
  subsp. aureus CIG1500

SEQ ID NO: 37307 - protein, 681 aa, Staphylococcus aureus; identical to SEQ ID NO: 34710
  subsp. aureus CIG1500

SEQ ID NO: 37308 - protein, 809 aa, Staphylococcus aureus; identical to SEQ ID NO: 36394
  subsp. aureus CIG1500

SEQ ID NO: 37309 - protein, 476 aa, Staphylococcus aureus
  subsp. aureus CIG1500
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 37310 - protein, 221 aa, Staphylococcus aureus; identical to SEQ ID NO: 31036
  subsp. aureus CIG1500

SEQ ID NO: 37311 - protein, 226 aa, Staphylococcus aureus; identical to SEQ ID NO: 31265
  subsp. aureus CIG1500

SEQ ID NO: 37312 - protein, 233 aa, Staphylococcus aureus; identical to SEQ ID NO: 31264
  subsp. aureus CIG1500

SEQ ID NO: 37313 - protein, 343 aa, Staphylococcus aureus; identical to SEQ ID NO: 31263
  subsp. aureus CIG1500

SEQ ID NO: 37314 - protein, 306 aa, Staphylococcus aureus; identical to SEQ ID NO: 31262
  subsp. aureus CIG1500

SEQ ID NO: 37315 - protein, 234 aa, Staphylococcus aureus; identical to SEQ ID NO: 30567
  subsp. aureus CIG1500

SEQ ID NO: 37316 - protein, 231 aa, Staphylococcus aureus; identical to SEQ ID NO: 30566
  subsp. aureus CIG1500

SEQ ID NO: 37317 - protein, 232 aa, Staphylococcus aureus; identical to SEQ ID NO: 30565
  subsp. aureus CIG1500

SEQ ID NO: 37318 - protein, 227 aa, Staphylococcus aureus; identical to SEQ ID NO: 30564
  subsp. aureus CIG1500

SEQ ID NO: 37319 - protein, 691 aa, Staphylococcus aureus; identical to SEQ ID NO: 31040
  subsp. aureus CIG1500

SEQ ID NO: 37320 - protein, 232 aa, Staphylococcus aureus; identical to SEQ ID NO: 31257
  subsp. aureus CIG1500

SEQ ID NO: 37321 - protein, 924 aa, Staphylococcus aureus; identical to SEQ ID NO: 34735
  subsp. aureus CIG1500

SEQ ID NO: 37322 - protein, 1374 aa, Staphylococcus aureus; identical to SEQ ID NO: 36154
  subsp. aureus CIG1500

SEQ ID NO: 37323 - protein, 1137 aa, Staphylococcus aureus; identical to SEQ ID NO: 31254
  subsp. aureus CIG1500

SEQ ID NO: 37324 - protein, 434 aa, Staphylococcus aureus [sequence omitted]

SEQ ID NO: 37325 - protein, 1027 aa, Staphylococcus aureus
  subsp. aureus CIG1500
MKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 37326 - protein, 257 aa, Staphylococcus aureus; identical to SEQ ID NO: 31220
  subsp. aureus CIG1500

SEQ ID NO: 37327 - protein, 689 aa, Staphylococcus aureus; identical to SEQ ID NO: 31224
  subsp. aureus CIG1500

SEQ ID NO: 37328 - protein, 652 aa, Staphylococcus aureus; identical to SEQ ID NO: 34746
  subsp. aureus CIG1500

SEQ ID NO: 37329 - protein, 354 aa, Staphylococcus aureus; identical to SEQ ID NO: 30412
  subsp. aureus CIG1500

SEQ ID NO: 37330 - protein, 105 aa, Staphylococcus aureus; identical to SEQ ID NO: 31168
  subsp. aureus CIG1500

SEQ ID NO: 37331 - protein, 165 aa, Staphylococcus aureus; identical to SEQ ID NO: 31241
  subsp. aureus CIG1500

SEQ ID NO: 37332 - protein, 206 aa, Staphylococcus aureus; identical to SEQ ID NO: 34750
  subsp. aureus CIG1500

SEQ ID NO: 37333 - protein, 112 aa, Staphylococcus aureus; identical to SEQ ID NO: 34751
  subsp. aureus CIG1500

SEQ ID NO: 37334 - protein, 238 aa, Staphylococcus aureus; identical to SEQ ID NO: 31240
  subsp. aureus CIG1500

SEQ ID NO: 37335 - protein, 241 aa, Staphylococcus aureus; identical to SEQ ID NO: 31239
  subsp. aureus CIG1500

SEQ ID NO: 37336 - protein, 241 aa, Staphylococcus aureus; identical to SEQ ID NO: 31238
  subsp. aureus CIG1500

SEQ ID NO: 37337 - protein, 372 aa, Staphylococcus aureus; identical to SEQ ID NO: 33950
  subsp. aureus CIG1500

SEQ ID NO: 37338 - protein, 62 aa, Staphylococcus aureus; identical to SEQ ID NO: 31886
  subsp. aureus CIG1500

SEQ ID NO: 37339 - protein, 151 aa, Staphylococcus aureus; identical to SEQ ID NO: 35733
  subsp. aureus CIG1500

SEQ ID NO: 37340 - protein, 270 aa, Staphylococcus aureus; identical to SEQ ID NO: 35140
  subsp. aureus CIG1500

SEQ ID NO: 37341 - protein, 278 aa, Staphylococcus aureus; identical to SEQ ID NO: 34714
  subsp. aureus CIG1500

SEQ ID NO: 37342 - protein, 2189 aa, Staphylococcus aureus; identical to SEQ ID NO: 31236
  subsp. aureus CIG1500

SEQ ID NO: 37343 - protein, 331 aa, Staphylococcus aureus; identical to SEQ ID NO: 31235
  subsp. aureus CIG1500

SEQ ID NO: 37344 - protein, 806 aa, Staphylococcus aureus; identical to SEQ ID NO: 31234
  subsp. aureus CIG1500

SEQ ID NO: 37345 - protein, 258 aa, Staphylococcus aureus; identical to SEQ ID NO: 30518
  subsp. aureus CIG1500

SEQ ID NO: 37346 - protein, 165 aa, Staphylococcus aureus; identical to SEQ ID NO: 33973
  subsp. aureus CIG1500

SEQ ID NO: 37347 - protein, 261 aa, Staphylococcus aureus; identical to SEQ ID NO: 37106
  subsp. aureus CIG1500

SEQ ID NO: 37348 - protein, 242 aa, Staphylococcus aureus; identical to SEQ ID NO: 30522
  subsp. aureus CIG1500

SEQ ID NO: 37349 - protein, 239 aa, Staphylococcus aureus; identical to SEQ ID NO: 30171
  subsp. aureus CIG1500

SEQ ID NO: 37350 - protein, 254 aa, Staphylococcus aureus; identical to SEQ ID NO: 31226
  subsp. aureus CIG1500

SEQ ID NO: 37351 - protein, 274 aa, Staphylococcus aureus; identical to SEQ ID NO: 35568
  subsp. aureus CIG1500

SEQ ID NO: 37352 - protein, 339 aa, Staphylococcus aureus; identical to SEQ ID NO: 31219
  subsp. aureus CIG1500

SEQ ID NO: 37353 - protein, 351 aa, Staphylococcus aureus; identical to SEQ ID NO: 31218
  subsp. aureus CIG1500

SEQ ID NO: 37354 - protein, 234 aa, Staphylococcus aureus; identical to SEQ ID NO: 30530
  subsp. aureus CIG1500

SEQ ID NO: 37355 - protein, 44 aa, Staphylococcus aureus; identical to SEQ ID NO: 30513
  subsp. aureus CIG1500

SEQ ID NO: 37356 - protein, 231 aa, Staphylococcus aureus; identical to SEQ ID NO: 31216
  subsp. aureus CIG1500

SEQ ID NO: 37357 - protein, 309 aa, Staphylococcus aureus; identical to SEQ ID NO: 33946
  subsp. aureus CIG1524

SEQ ID NO: 37358 - protein, 315 aa, Staphylococcus aureus; identical to SEQ ID NO: 30183
  subsp. aureus CIG1524

SEQ ID NO: 37359 - protein, 325 aa, Staphylococcus aureus; identical to SEQ ID NO: 32859
  subsp. aureus CIG1524

SEQ ID NO: 37360 - protein, 691 aa, Staphylococcus aureus
  subsp. aureus CIG1524
MLRGQEERKYSIRKYSIGVVSVLAATMFVVSSHEAQASEKTPTSNAAAQKETLNQSGEQGNAITSHQMQSGKQLDDMHKKNDKSGTVTEGKDTLQSSKHQSTQNSKTIRTQNDDQVKQDSERQGSKQSHQNNATNKTERQNDQVLNTHHAERNGSQSTTSQSNDVDKSQPSIPAQKVITNHDKAATTSTTPPSNDKTAPKSTKAQDASTDKHPNQQDTHQPAHQIIDAKQDDNVHQSEQKPQVGDLSKHIDGQNSPEKPTDKNNDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHQAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNNEPATRRGIWQVKPILQGWDHVDFIGVDFLDFKRKGSELANFYIGIINDLLSVEATEGKGTQLKAS

SEQ ID NO: 37361 - protein, 950 aa, Staphylococcus aureus; identical to SEQ ID NO: 34117
  subsp. aureus CIG1524

SEQ ID NO: 37362 - protein, 1053 aa, Staphylococcus aureus; identical to SEQ ID NO: 32857
  subsp. aureus CIG1524

SEQ ID NO: 37363 - protein, 55 aa, Staphylococcus aureus; identical to SEQ ID NO: 33933
  subsp. aureus CIG1524

SEQ ID NO: 37364 - protein, 226 aa, Staphylococcus aureus; identical to SEQ ID NO: 32850
  subsp. aureus CIG1524

SEQ ID NO: 37365 - protein, 233 aa, Staphylococcus aureus; identical to SEQ ID NO: 32849
  subsp. aureus CIG1524

SEQ ID NO: 37366 - protein, 343 aa, Staphylococcus aureus; identical to SEQ ID NO: 32848
  subsp. aureus CIG1524

SEQ ID NO: 37367 - protein, 282 aa, Staphylococcus aureus; identical to SEQ ID NO: 32847
  subsp. aureus CIG1524

SEQ ID NO: 37368 - protein, 234 aa, Staphylococcus aureus; identical to SEQ ID NO: 32846
  subsp. aureus CIG1524

SEQ ID NO: 37369 - protein, 232 aa, Staphylococcus aureus; identical to SEQ ID NO: 32845
  subsp. aureus CIG1524

SEQ ID NO: 37370 - protein, 227 aa, Staphylococcus aureus; identical to SEQ ID NO: 32844
  subsp. aureus CIG1524

SEQ ID NO: 37371 - protein, 231 aa, Staphylococcus aureus; identical to SEQ ID NO: 32843
  subsp. aureus CIG1524

SEQ ID NO: 37372 - protein, 233 aa, Staphylococcus aureus; identical to SEQ ID NO: 32856
  subsp. aureus CIG1524

SEQ ID NO: 37373 - protein, 1001 aa, Staphylococcus aureus
  subsp. aureus CIG1524
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNGQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPKPDPEPSPDPEPEPTPDPEPSPDPEPEPTPDPEPTPDPEPSPDPEPSPDPEPSPDPDPDSDSDSDSDSGSDSDSDSESDSDSDSDSGSDSDSDSESDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSESDSDSDSDSDSESDSDSESDSDSDSDSDSDSDSDSDSDSDSDSDSDSDSDSDSDSDSDSDSDSDSDSDSDSDSDSDSESDSDSDSDSDSESDSDSDSDSDSDSDSDSDSDSDSDSDSDSDSDSDSESDSDSDSDSDSDSDSDSESDSDSDSDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 37374 - protein, 806 aa, Staphylococcus aureus; identical to SEQ ID NO: 34100
  subsp. aureus CIG1524

SEQ ID NO: 37375 - protein, 141 aa, Staphylococcus aureus; identical to SEQ ID NO: 32806
  subsp. aureus CIG1524

SEQ ID NO: 37376 - protein, 2263 aa, Staphylococcus aureus
  subsp. aureus CIG1524
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTFSKNTTSSSDTKSVASTSSTEQPINTSTNQSTASNNTSQSTTPSSANLNKTSTTSTSTAPVKIRTFSRLAMSTFASAATTSAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNASAKAKADPSSVAGGGAFGAFVTTDSYGVASTYTSSSAADNAAKLNVQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSVAGSQSVSTSTSDSMSTSEIVSDSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMSLSMSQSISGSTSTSTSTSLSDSTSTSLSLSASMNQSGVDSNSASQSASTSTSTSTSESDSQSTSSYTSQSTSQSESTSTSTSLSDSTSMSKSTSQSGSTSTSASLSGSESESDSQSVSTSASESTSESASTSLSDSTSTSNSTSESTSNAISTSASASESDSSSTSLSDSTSASMQSSESDSQSTSTSLSNSQSTSTSIRMSTIVSESVSESTSESGSTSESTSESDSTSTSLSDSQSTSRSTSASGSASTSTSTSDSRSTSASTSTSMRTSTLDSQSMSLSTSTSTSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSMSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSISNSESVSTSTSTSLSTSDSTSTSESLSTSMSGSQSISDSTSTSMSNSTSMSNSTSTSMSGSTSTSESNSMHPSDSMSMHHTHSTSTSISTSEATTSTSESQSTLSATSEATKHNGTRAQSEERLPDTGESIKQNGLLGGIMTLLVGLGLMKRKKKKDENDQDDSQA

SEQ ID NO: 37377 - protein, 681 aa, Staphylococcus aureus; identical to SEQ ID NO: 32855
  subsp. aureus CIG1524

SEQ ID NO: 37378 - protein, 809 aa, Staphylococcus aureus; identical to SEQ ID NO: 33898
  subsp. aureus CIG1524

SEQ ID NO: 37379 - protein, 492 aa, Staphylococcus aureus
  subsp. aureus CIG1524
MKKKNIYSIRKLGVGIASVTLGTLLISGGVTPAANAAQHDEAQQNAFYQVLNMPNLNADQRNGFIQSLKDDPSQSANVLGEAKKLNDSQAPKAEAQQNNFNKDQQSAFYEILNMPNLNEAQRNGFIQSLKDDPSQSTNVLGEAKKLNESQAPKADNNFNKDQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDGNKPGKEDNKKPGKEDGNKPGKEDNNKPGKEDGNKPGKEDNKKPGKEDGNKPGKEDNKKPGKEDGNGVHVVKPGDTVNDIAKANGTTADKIASDNKLADKNMIKPGQELVVDKKQPANHADANKAQALPETGEENPFIGTTVFGGLSLALGAALLAGRRREL

SEQ ID NO: 37380 - protein, 241 aa, Staphylococcus aureus; identical to SEQ ID NO: 32842
  subsp. aureus CIG1524

SEQ ID NO: 37381 - protein, 998 aa, Staphylococcus aureus
  subsp. aureus CIG1524
MNNKKTAINRKGMIPNRLNKFSIRKYSVGTASILVGTTLIFGLSGHEAKAAEHTNGELNQSKNETTDSSENKTTEKVDSRQQNNIEQSTTSNQPKVNESDNTSVKETTEEPQNTTSTQPTKQNNDATANKDNLEAQNISTQAKDVSATPKTTTIKPRTLNRLAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENAITDKTAYKMEVTLGNDAYSEEIIVDYGNKKAQPLITSTNYINNEDLSRNMTAYVNQPKNTYTKETFVSTLTGYKFNPNAKNFKIYEVTDQNQFVDSFTPDTSKLTDVTDQFDITYSNDNKTATVDLMKGQTSSNKQYIIQQVAYPENTSTDNGKIDYTLETDKTKYSWSNSYSNVNGSSTANGDQKKYNLGDYVWEDTNKDGKQDADEKGIKGVYVILKDSNGKELDRTTTDENGKYQFTGLSNGTYSVEFSTPDGYTPTTANAGTDDAVDSDGLTTTGVIKDADNWTLDSGFYKTPKYSLGDYVWYDSNKDGKQDSTEKGIKGVKVTLQNEKGEVIGTTETDENGKYRFDNLDSGKYKVIFEKPAGLTQTGTNTTDDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNAGKHTPAKPMSAVKDHNNKAKALPETGTENNNSNNGTLFGGLFAALGSLLLFGRRKKQNK

SEQ ID NO: 37382 - protein, 1198 aa, Staphylococcus aureus
  subsp. aureus CIG1524
MLNRENKTAMTRKGMVSNRLNKFSIRKYTVGTASILVGTTLIFGIGSQEAKAAEVTNKEMKEDATSVNNDQVSKKVDTGQLNKDGNTSKVDTEQLNDENINKVANQKEVTRVENSVASEKNNNSQPSENGKLQTSDVKKTEDNNATSDDQVTTTVNSQQLNTDNTTSNATMSAAPINVSKDDLKINSEEVRNVGEKSDNTDNANGSDVIMPKSTAPKRLNTRMRIAAVQPSSTDSKNVNNLITSTTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPLGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLIQTGTNTTEDDKDADGGEVDVTITDHDDFTIDNGYFEEDTSDSDSDSDSDSDSDSDSDSDSDSDAGKHTPVKPMSATKDHHKKAKALPETGSENNGSNNATLFGGLFAALGSLLLFGRRKKQNK

SEQ ID NO: 37383 - protein, 1147 aa, Staphylococcus aureus
  subsp. aureus CIG1524
MINRDNKKAITKKGMISNRLNKFSIRKYTVGTASILVGTTLIFGLGNQEAKAAENTSTENAKQDDATTSDNKEVVSETENNSTTENNLTNPIKKETNTDSQQEAKEAPTTSSTQQQQNNATTSTETRPQNIEKENVQPSTDKTATEDTSVILEEKKAPNNTNNDVTTKPSTSEIQTAPTTPQESTKIENSQPQATPSKVDNQVTDATNPKESVNVSKEELKNNPEKLKELVRNDSNTDRSTKPVAIAPTSVTPKRVNAKMRFAVAQPAAVASNNVNDLIKVTKQTIKVGDDEDNVVSAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDTTEKGIKDVTVTLQNEKGEVIGTTKTDENGKYRFDNLDSGKYKVIFEKPAGLTQTGTNTTEDDKDADGGEVDVTITDHDDFTIDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSESDSDSDTGKHTPVKPMSTTKDHHNKAKALPETGSENNGSNNATLFGGLFAALGSLLLFGRRKKQNK

SEQ ID NO: 37384 - protein, 434 aa, Staphylococcus aureus [sequence omitted]

SEQ ID NO: 37385 - protein, 973 aa, Staphylococcus aureus; identical to SEQ ID NO: 34134
  subsp. aureus CIG1524

SEQ ID NO: 37386 - protein, 644 aa, Staphylococcus aureus; identical to SEQ ID NO: 32834
  subsp. aureus CIG1524

SEQ ID NO: 37387 - protein, 350 aa, Staphylococcus aureus; identical to SEQ ID NO: 32833
  subsp. aureus CIG1524

SEQ ID NO: 37388 - protein, 109 aa, Staphylococcus aureus; identical to SEQ ID NO: 30603
  subsp. aureus CIG1524

SEQ ID NO: 37389 - protein, 165 aa, Staphylococcus aureus; identical to SEQ ID NO: 32831
  subsp. aureus CIG1524

SEQ ID NO: 37390 - protein, 319 aa, Staphylococcus aureus; identical to SEQ ID NO: 32830
  subsp. aureus CIG1524

SEQ ID NO: 37391 - protein, 238 aa, Staphylococcus aureus
  subsp. aureus CIG1524
MRKSNIKKLILMTTLLLLGTTATQIPNSPLNVSTDAKAYYIDQNETNINELIKYYTQKPLTFSNRWLYQYDDGNIYVEFKRYSWSAHIRLWGAESWGNINQLRDRYVDVFGLKDEDTSQLWWVYRDTFTGGVTPAASSSDKPYSLFVQYKDKLQTIIGAHKMYQGNKPILTLKEIDFRAREALIKNKILYHENRNKGKLKITGGGNDYTIDLSKRLHSDLANFYVKNPQKITVEVLID

SEQ ID NO: 37392 - protein, 241 aa, Staphylococcus aureus; identical to SEQ ID NO: 32828
  subsp. aureus CIG1524

SEQ ID NO: 37393 - protein, 241 aa, Staphylococcus aureus; identical to SEQ ID NO: 32827
  subsp. aureus CIG1524

SEQ ID NO: 37394 - protein, 372 aa, Staphylococcus aureus
  subsp. aureus CIG1524
MNKQQSKVRYSIRKVSIGILSISIGMFLALGMSNKAYADEIDKSKDFTRAYEQNVFAKSELNANKNTTKDKIKNEAVVKTSDTSLKLDNKSAISNGNEINQDIKISNTPKNSSQGNNLVVNNNEPTKEIKIANLEAQNSNQKKVNKGTNNYFSYYSFREAPKTQIYTVKKGDTLSAIALKYKTTVSNIQNTNNIANPNLIFIGQKLKVPMTPLVEPKPKTVSSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 37395 - protein, 250 aa, Staphylococcus aureus; identical to SEQ ID NO: 32837
  subsp. aureus CIG1524

SEQ ID NO: 37396 - protein, 291 aa, Staphylococcus aureus; identical to SEQ ID NO: 30390
  subsp. aureus CIG1524

SEQ ID NO: 37397 - protein, 891 aa, Staphylococcus aureus; identical to SEQ ID NO: 32839
  subsp. aureus CIG1524

SEQ ID NO: 37398 - protein, 2185 aa, Staphylococcus aureus
  subsp. aureus CIG1524
MNLLKKNKYSIRNYKVGIFSTLIGTVLLLSNPNGAQALTTDHNVQGGSNQALPGNSQNTNADTNRNIVNGSQNTPNADATDNTSTNQALTNHQNVGVANQVAPTPVQPNSLSELNNNHSDAHATVTETASNTNHHLAANNSTLNVPNNINDNDSERHLTLKEIQEDVRHSSDKPELVAIAEEASNRPKKRSRRAAPADPNATPADPAAGNGGAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIKGNDTNDHGDFNGIEKTLTVNPNSELIFEFNTMTTKNYQGMTNLVIKNADNDAILGEKVVAYGPIWRLFKVPENVSHLKIQFSPKNDAITDVRGIYQLRDGYKYYDFVDSIGLHSGSHLYVERRIMEPTATNNKEFTVTTSLKNNGNFGASFNTDDFVYKIQLPEGVEYVNNSLTKDFPSGNSGVDMNDMNDMNVTYDATNRVITIKSTGGGSGNSPARLMPDKILDLKYKLRVNNVPTPRTVTFNDTLTYKTFSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINNTPDATQDEIQDALNQLTTDETDAIDNVTNATTNADVETAKNNGINTIGAVVPQVTHKQAARDAINQATATKRQQINSNREATQEEKNAALNELTQATNHALEQINQATTNDDVDTAKGDGLNVINPIAPVTVVKQAARDAVSHDAQQHIAEINANPDATQEERQAAIEKVNAAVAAANTNILNANSNADVEQVKTNAIQGIQAIEPATKVKTDAKNAIDQSAETQHNAIFNNNDATLEEQQAAQQLLDQAVATAKQNINAADTNQEVAQAKDQGTQNILAIQPATQVKTDARNTVNEKAREAISNINATPGATREEKQEAIDRVNTLKNRALTDIGVTSTTAMVNSIRDDAVNQIGTVQPHVTKKQSATGVLTDLATAKKQEINQNTNATDEEKQVALNQVDQDLATAINNINQADTNAEVDQALQAGKQAMNAIQPNIVKKPAVLAQINQHYNAKLAEINATPDATDDEKNAAINILNQDRQQAIESIKLANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATDGITAIKMIQPETKVKPAAREKINQKANELRAQINQDKEATAEERQAALDKINDLVAKAMTNITNDRTNQQVNDSTNQALDDIALVTPDHIVRATARDAVKQQYEVKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQNIDNTTQDAAVNDVRNQTIKAIEQIKPKVRRKRAALDNIDESNNNQLAAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKTTALQQIQNIATHKINLIKSNNEATDEEQNAAIAQVEQALIKAKQHIASAVTNADVAYLLHDGKNEIREIEPVINRKASAREQLTTLLNDKKQAIEANVQATVEERNSVLAQLQNIYDAAIGQLDHDRSNAQVDKTASFNLQTIQGLDVHPVKKPEAEKTINQDIARVTHLVQNYRKVSDRNKADALKAITALKLQMDEELKTARTNADVDAVLKRFNVALGDIEAVITEKEHSLMRIENIAQQTYAKFKAIATPEQLAKVKALIDQYVADGNRMIDEDATLNDIKQHTQFIIDEILAIKLPAEVIKASPKVGQPAPKVCTPIKKEDKQEVRKVEKELPNTGSEEMDLPLKELALITGAALLARRRTKNEKES

SEQ ID NO: 37399 - protein, 331 aa, Staphylococcus aureus; identical to SEQ ID NO: 32807
  subsp. aureus CIG1524

SEQ ID NO: 37400 - protein, 258 aa, Staphylococcus aureus; identical to SEQ ID NO: 30410
  subsp. aureus CIG1524

SEQ ID NO: 37401 - protein, 165 aa, Staphylococcus aureus; identical to SEQ ID NO: 30805
  subsp. aureus CIG1524

SEQ ID NO: 37402 - protein, 256 aa, Staphylococcus aureus; identical to SEQ ID NO: 32820
  subsp. aureus CIG1524

SEQ ID NO: 37403 - protein, 242 aa, Staphylococcus aureus; identical to SEQ ID NO: 32821
  subsp. aureus CIG1524

SEQ ID NO: 37404 - protein, 239 aa, Staphylococcus aureus; identical to SEQ ID NO: 32822
  subsp. aureus CIG1524

SEQ ID NO: 37405 - protein, 254 aa, Staphylococcus aureus; identical to SEQ ID NO: 32823
  subsp. aureus CIG1524

SEQ ID NO: 37406 - protein, 689 aa, Staphylococcus aureus; identical to SEQ ID NO: 32816
  subsp. aureus CIG1524

SEQ ID NO: 37407 - protein, 274 aa, Staphylococcus aureus; identical to SEQ ID NO: 30872
  subsp. aureus CIG1524

SEQ ID NO: 37408 - protein, 326 aa, Staphylococcus aureus
  subsp. aureus CIG1524
MALSTALTVFPASSYAEIKSKITTVSEKNLDGDTKMYTRTATTSDTEKKISQSLQFNFLTEPNYDKETVFIKAKGTIGSGLKILNPNGYWNSTLRWPGSYSVSIQNVDDNNNSTNVTDFAPKNQDESREVKYTYGYKTGGDFSINRGGLTGNITKEKNYSETISYQQPSYRTLIDQPTTNKGVAWKVEAHSINNMGHDHTRQLTNDSDDRVKSEIFSLTRNGNLWAKDNFTPKNKMPVTVSEGFNPEFLAVMSHDKNDKGKSRFIVHYKRSMDDFKLDWNKHGFWGYWSGENHVDQKEEKLSALYEVDWKTHDVKLIKTFNDKEKK

SEQ ID NO: 37409 - protein, 351 aa, Staphylococcus aureus; identical to SEQ ID NO: 32811
  subsp. aureus CIG1524

SEQ ID NO: 37410 - protein, 44 aa, Staphylococcus aureus; identical to SEQ ID NO: 30513
  subsp. aureus CIG1524

SEQ ID NO: 37411 - protein, 231 aa, Staphylococcus aureus; identical to SEQ ID NO: 33931
  subsp. aureus CIG1524

SEQ ID NO: 37412 - protein, 2459 aa, Staphylococcus aureus
  subsp. aureus CIG1524
MNLFRQQKFSIRKFNVGIFSALIATVTFISINPTTASAAEQNQPAQNQPAQPADASAQPNANAGAQANPTAQPAAPANQGGQADPAANQGGQATPAAGTTQPAAGTTQPAAGTTQPAGQGNQADPNNAVQAQPGNQAAPANQAGQGNNQATPNNAAPANQTQPANAPAAAQPAAPVAANAQPQDPNANNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHYTTASIAEYNKLKQQADTILNEDANHVETANRASQADIDGLVTKLQAALIDNQAAIAELDAKAQEKVTAAQQSKKVTQDEVAALVTIINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINKAKVSGVKAIEATTTAQELERVKNEEIFKIENITDSTQTKMDAYKEVKQAATARKAQNATVSNATDEEVAEANAAVDAAQTEGLHDIQVVKSQQEVADTKAKVLDKINAIQTQARVKPAADREVDNAYNTRKQEIQNSNASTTEEKEAAYTQLDAKKQEARTNLDAANTNSAVTTAKDNGIAAINQVQAATTKKSDAKAEIAQKASERKTAIEAMNDSTTEEQQAAKDKVDQAVVTANADIDNAAANTDVDNAKATNEATIAAITPDANVKSTAKQAIADKVQAQETAIDANNGATTEEKNAAKQQVQTEKTTADAAIDGAHSNAEVEAAKNAEIAKIEAIQPATTTKDDAKQAIATKANERKAAIAQTQDITAEEIEAANANVDNAVTEANSHIEAANSQNEVDQAKTTGESSIDQVTPTVNKKATARNEITTALNNKLQEIQATPDATDEEKQEADLEANTENAKANHAITAATTNAEVDDAKANAEVAINAVTPKVMKKQAAKDEIDQLQAVQTAIINNDQNATNEEKEAAIQQLATAVTDAKNNITAATDNNGVDTAKDAGKNSIQSTQPATAVKSNAKNDVDQAVTTQNQAIDNTTDATTEEKNAAKDLVLKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLNEMQNKITEILNDNTTTNEEKGKDIGPVRAAYEEGLNNINTSTTTGDVTTAKDAAVQKVQQLHANPVKKPSGKTALDQAAADKKTQIEQTPNASQQEINDAKQEVDTVLNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTIATQDEKQQAIKQVDQNVQTALESINNGVDNGDVDDALTQGKATIDAVQVDASVKPKANQAIEAKAEETKESIDQSDQLTAEEKTEALATIKQITDQAKQGITDAATTAEVEKAKAQGLEAFDNIQIDSTEKQKAIEELETALDQIEAGVNVDSDATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVDELQNVTIPAIEAIVPQKDPNANDTNSGSDNNDATANSNTNATPENTGQPNVTESTDNANADTSSTTTNNHNDSATGETTGTSTNNSSTDDANDKPTANNNSSVDASTDNSATGNGTNDKPAVELTNNGTTDKPATTESTETTSTADRKDNASVNASNQNAEVNNSAESQPINGKVAQPKSENKAKVEKDGRDSTNQSMVESTTETLPSADITEPNVPSNTSKDKEESTSNQTDAGQLKSETNVASNEADKSPSKADTAVSNKPSTSASSETKDKATSTEDSQKADMATADTKDNQAAIGATADVNNKAMQNDGANASPVTVSNGSHSMHHDMLKVTNTDKHEAKATSAQQGKENKAKQQAKTLPDTGMSHNDDLPYAELALGAGMAFLIRRFTKKDQQTEE

SEQ ID NO: 37413 - protein, 843 aa, Staphylococcus aureus
  subsp. aureus CIG1605
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSNSDSDSDSDSDSDSDSDSDSDSDSESDSDSDSDSDSDSDSDSDSDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 37414 - protein, 1351 aa, Staphylococcus aureus; identical to SEQ ID NO: 31203
  subsp. aureus CIG1605

SEQ ID NO: 37415 - protein, 681 aa, Staphylococcus aureus; identical to SEQ ID NO: 34710
  subsp. aureus CIG1605

SEQ ID NO: 37416 - protein, 809 aa, Staphylococcus aureus; identical to SEQ ID NO: 36878
  subsp. aureus CIG1605

SEQ ID NO: 37417 - protein, 808 aa, Staphylococcus aureus; identical to SEQ ID NO: 31215
  subsp. aureus CIG1605

SEQ ID NO: 37418 - protein, 141 aa, Staphylococcus aureus; identical to SEQ ID NO: 31214
  subsp. aureus CIG1605

SEQ ID NO: 37419 - protein, 309 aa, Staphylococcus aureus; identical to SEQ ID NO: 33946
  subsp. aureus CIG1605

SEQ ID NO: 37420 - protein, 315 aa, Staphylococcus aureus; identical to SEQ ID NO: 31191
  subsp. aureus CIG1605

SEQ ID NO: 37421 - protein, 325 aa, Staphylococcus aureus; identical to SEQ ID NO: 30479
  subsp. aureus CIG1605

SEQ ID NO: 37422 - protein, 942 aa, Staphylococcus aureus; identical to SEQ ID NO: 35550
  subsp. aureus CIG1605

SEQ ID NO: 37423 - protein, 233 aa, Staphylococcus aureus; identical to SEQ ID NO: 31039
  subsp. aureus CIG1605

SEQ ID NO: 37424 - protein, 516 aa, Staphylococcus aureus; identical to SEQ ID NO: 31270
  subsp. aureus CIG1605

SEQ ID NO: 37425 - protein, 221 aa, Staphylococcus aureus; identical to SEQ ID NO: 31036
  subsp. aureus CIG1605

SEQ ID NO: 37426 - protein, 691 aa, Staphylococcus aureus; identical to SEQ ID NO: 31040
  subsp. aureus CIG1605

SEQ ID NO: 37427 - protein, 226 aa, Staphylococcus aureus; identical to SEQ ID NO: 31265
  subsp. aureus CIG1605

SEQ ID NO: 37428 - protein, 233 aa, Staphylococcus aureus; identical to SEQ ID NO: 31264
  subsp. aureus CIG1605

SEQ ID NO: 37429 - protein, 343 aa, Staphylococcus aureus; identical to SEQ ID NO: 31263
  subsp. aureus CIG1605

SEQ ID NO: 37430 - protein, 306 aa, Staphylococcus aureus; identical to SEQ ID NO: 31262
  subsp. aureus CIG1605

SEQ ID NO: 37431 - protein, 234 aa, Staphylococcus aureus; identical to SEQ ID NO: 30567
  subsp. aureus CIG1605

SEQ ID NO: 37432 - protein, 231 aa, Staphylococcus aureus; identical to SEQ ID NO: 30566
  subsp. aureus CIG1605

SEQ ID NO: 37433 - protein, 232 aa, Staphylococcus aureus; identical to SEQ ID NO: 30565
  subsp. aureus CIG1605

SEQ ID NO: 37434 - protein, 227 aa, Staphylococcus aureus; identical to SEQ ID NO: 30564
  subsp. aureus CIG1605

SEQ ID NO: 37435 - protein, 232 aa, Staphylococcus aureus; identical to SEQ ID NO: 31257
  subsp. aureus CIG1605

SEQ ID NO: 37436 - protein, 924 aa, Staphylococcus aureus; identical to SEQ ID NO: 34735
  subsp. aureus CIG1605

SEQ ID NO: 37437 - protein, 1368 aa, Staphylococcus aureus
  subsp. aureus CIG1605
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 37438 - protein, 1137 aa, Staphylococcus aureus; identical to SEQ ID NO: 31254
  subsp. aureus CIG1605

SEQ ID NO: 37439 - protein, 434 aa, Staphylococcus aureus [sequence omitted]

SEQ ID NO: 37440 - protein, 1029 aa, Staphylococcus aureus
  subsp. aureus CIG1605
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSDSDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 37441 - protein, 257 aa, Staphylococcus aureus; identical to SEQ ID NO: 31220
  subsp. aureus CIG1605

SEQ ID NO: 37442 - protein, 689 aa, Staphylococcus aureus; identical to SEQ ID NO: 31224
  subsp. aureus CIG1605

SEQ ID NO: 37443 - protein, 652 aa, Staphylococcus aureus; identical to SEQ ID NO: 34746
  subsp. aureus CIG1605

SEQ ID NO: 37444 - protein, 354 aa, Staphylococcus aureus; identical to SEQ ID NO: 30412
  subsp. aureus CIG1605

SEQ ID NO: 37445 - protein, 105 aa, Staphylococcus aureus; identical to SEQ ID NO: 31168
  subsp. aureus CIG1605

SEQ ID NO: 37446 - protein, 165 aa, Staphylococcus aureus; identical to SEQ ID NO: 31241
  subsp. aureus CIG1605

SEQ ID NO: 37447 - protein, 206 aa, Staphylococcus aureus; identical to SEQ ID NO: 34750
  subsp. aureus CIG1605

SEQ ID NO: 37448 - protein, 112 aa, Staphylococcus aureus; identical to SEQ ID NO: 34751
  subsp. aureus CIG1605

SEQ ID NO: 37449 - protein, 238 aa, Staphylococcus aureus; identical to SEQ ID NO: 31240
  subsp. aureus CIG1605

SEQ ID NO: 37450 - protein, 241 aa, Staphylococcus aureus; identical to SEQ ID NO: 31239
  subsp. aureus CIG1605

SEQ ID NO: 37451 - protein, 241 aa, Staphylococcus aureus; identical to SEQ ID NO: 31238
  subsp. aureus CIG1605

SEQ ID NO: 37452 - protein, 372 aa, Staphylococcus aureus; identical to SEQ ID NO: 33950
  subsp. aureus CIG1605

SEQ ID NO: 37453 - protein, 62 aa, Staphylococcus aureus; identical to SEQ ID NO: 31886
  subsp. aureus CIG1605

SEQ ID NO: 37454 - protein, 167 aa, Staphylococcus aureus; identical to SEQ ID NO: 31885
  subsp. aureus CIG1605

SEQ ID NO: 37455 - protein, 270 aa, Staphylococcus aureus; identical to SEQ ID NO: 35140
  subsp. aureus CIG1605

SEQ ID NO: 37456 - protein, 278 aa, Staphylococcus aureus; identical to SEQ ID NO: 34714
  subsp. aureus CIG1605

SEQ ID NO: 37457 - protein, 2189 aa, Staphylococcus aureus; identical to SEQ ID NO: 31236
  subsp. aureus CIG1605

SEQ ID NO: 37458 - protein, 331 aa, Staphylococcus aureus; identical to SEQ ID NO: 31235
  subsp. aureus CIG1605

SEQ ID NO: 37459 - protein, 806 aa, Staphylococcus aureus; identical to SEQ ID NO: 31234
  subsp. aureus CIG1605

SEQ ID NO: 37460 - protein, 258 aa, Staphylococcus aureus; identical to SEQ ID NO: 30518
  subsp. aureus CIG1605

SEQ ID NO: 37461 - protein, 165 aa, Staphylococcus aureus; identical to SEQ ID NO: 33973
  subsp. aureus CIG1605

SEQ ID NO: 37462 - protein, 261 aa, Staphylococcus aureus; identical to SEQ ID NO: 30506
  subsp. aureus CIG1605

SEQ ID NO: 37463 - protein, 242 aa, Staphylococcus aureus; identical to SEQ ID NO: 30522
  subsp. aureus CIG1605

SEQ ID NO: 37464 - protein, 239 aa, Staphylococcus aureus; identical to SEQ ID NO: 30171
  subsp. aureus CIG1605

SEQ ID NO: 37465 - protein, 254 aa, Staphylococcus aureus; identical to SEQ ID NO: 31226
  subsp. aureus CIG1605

SEQ ID NO: 37466 - protein, 231 aa, Staphylococcus aureus; identical to SEQ ID NO: 36931
  subsp. aureus CIG1605

SEQ ID NO: 37467 - protein, 91 aa, Staphylococcus aureus
  subsp. aureus CIG1605
MPVTVSEGFNPEFLAVMSHDKNDKGKSRFIVHYKRSMDDFKLDWNKHGFWGYWSGENHVDQKEEKLSALYEVDWKTHDVKLIKTINDKEQK

SEQ ID NO: 37468 - protein, 232 aa, Staphylococcus aureus
  subsp. aureus CIG1605
MIKQVCKNITICSLALSTALTVFPASSYAEIKSKITTVSEKNLDGDTKMYTRTATTSDTEKKISQSLQFNFLTEPNYDKETVFIKAKGTIGSGLKILNPNGYWNSTLRWPGSYSVSIQNVDDNNNSTNVTDFAPKNQDESREVKYTYGYKTGGDFSINRGGLTGNITKEKNYSETISYQQPSYRTLIDQPTTNKGVAWKVEAHSINNMGHDHTRQLTNDSDDRVKSEIFSLT

SEQ ID NO: 37469 - protein, 351 aa, Staphylococcus aureus; identical to SEQ ID NO: 31218
  subsp. aureus CIG1605

SEQ ID NO: 37470 - protein, 234 aa, Staphylococcus aureus; identical to SEQ ID NO: 30530
  subsp. aureus CIG1605

SEQ ID NO: 37471 - protein, 44 aa, Staphylococcus aureus; identical to SEQ ID NO: 30513
  subsp. aureus CIG1605

SEQ ID NO: 37472 - protein, 231 aa, Staphylococcus aureus; identical to SEQ ID NO: 31216
  subsp. aureus CIG1605

SEQ ID NO: 37473 - protein, 191 aa, Staphylococcus aureus; identical to SEQ ID NO: 36699
  subsp. aureus CIG1612

SEQ ID NO: 37474 - protein, 444 aa, Staphylococcus aureus; identical to SEQ ID NO: 32034
  subsp. aureus CIG1612

SEQ ID NO: 37475 - protein, 931 aa, Staphylococcus aureus; identical to SEQ ID NO: 36701
  subsp. aureus CIG1612

SEQ ID NO: 37476 - protein, 995 aa, Staphylococcus aureus; identical to SEQ ID NO: 31038
  subsp. aureus CIG1612

SEQ ID NO: 37477 - protein, 233 aa, Staphylococcus aureus; identical to SEQ ID NO: 30428
  subsp. aureus CIG1612

SEQ ID NO: 37478 - protein, 879 aa, Staphylococcus aureus; identical to SEQ ID NO: 36689
  subsp. aureus CIG1612

SEQ ID NO: 37479 - protein, 1503 aa, Staphylococcus aureus; identical to SEQ ID NO: 33069
  subsp. aureus CIG1612

SEQ ID NO: 37480 - protein, 681 aa, Staphylococcus aureus; identical to SEQ ID NO: 32025
  subsp. aureus CIG1612

SEQ ID NO: 37481 - protein, 241 aa, Staphylococcus aureus; identical to SEQ ID NO: 30776
  subsp. aureus CIG1612

SEQ ID NO: 37482 - protein, 807 aa, Staphylococcus aureus; identical to SEQ ID NO: 30716
  subsp. aureus CIG1612

SEQ ID NO: 37483 - protein, 141 aa, Staphylococcus aureus; identical to SEQ ID NO: 30715
  subsp. aureus CIG1612

SEQ ID NO: 37484 - protein, 484 aa, Staphylococcus aureus
  subsp. aureus CIG1612
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 37485 - protein, 309 aa, Staphylococcus aureus; identical to SEQ ID NO: 30406
  subsp. aureus CIG1612

SEQ ID NO: 37486 - protein, 315 aa, Staphylococcus aureus; identical to SEQ ID NO: 30440
  subsp. aureus CIG1612

SEQ ID NO: 37487 - protein, 325 aa, Staphylococcus aureus; identical to SEQ ID NO: 30407
  subsp. aureus CIG1612

SEQ ID NO: 37488 - protein, 690 aa, Staphylococcus aureus; identical to SEQ ID NO: 30419
  subsp. aureus CIG1612

SEQ ID NO: 37489 - protein, 203 aa, Staphylococcus aureus; identical to SEQ ID NO: 30770
  subsp. aureus CIG1612

SEQ ID NO: 37490 - protein, 226 aa, Staphylococcus aureus; identical to SEQ ID NO: 30769
  subsp. aureus CIG1612

SEQ ID NO: 37491 - protein, 231 aa, Staphylococcus aureus; identical to SEQ ID NO: 30768
  subsp. aureus CIG1612

SEQ ID NO: 37492 - protein, 67 aa, Staphylococcus aureus; identical to SEQ ID NO: 36707
  subsp. aureus CIG1612

SEQ ID NO: 37493 - protein, 234 aa, Staphylococcus aureus; identical to SEQ ID NO: 31052
  subsp. aureus CIG1612

SEQ ID NO: 37494 - protein, 231 aa, Staphylococcus aureus; identical to SEQ ID NO: 31761
  subsp. aureus CIG1612

SEQ ID NO: 37495 - protein, 231 aa, Staphylococcus aureus; identical to SEQ ID NO: 30560
  subsp. aureus CIG1612

SEQ ID NO: 37496 - protein, 232 aa, Staphylococcus aureus; identical to SEQ ID NO: 31054
  subsp. aureus CIG1612

SEQ ID NO: 37497 - protein, 232 aa, Staphylococcus aureus; identical to SEQ ID NO: 30765
  subsp. aureus CIG1612

SEQ ID NO: 37498 - protein, 227 aa, Staphylococcus aureus; identical to SEQ ID NO: 30585
  subsp. aureus CIG1612

SEQ ID NO: 37499 - protein, 225 aa, Staphylococcus aureus; identical to SEQ ID NO: 30763
  subsp. aureus CIG1612

SEQ ID NO: 37500 - protein, 109 aa, Staphylococcus aureus; identical to SEQ ID NO: 30744
  subsp. aureus CIG1612

SEQ ID NO: 37501 - protein, 165 aa, Staphylococcus aureus; identical to SEQ ID NO: 30742
  subsp. aureus CIG1612

SEQ ID NO: 37502 - protein, 319 aa, Staphylococcus aureus; identical to SEQ ID NO: 30741
  subsp. aureus CIG1612

SEQ ID NO: 37503 - protein, 238 aa, Staphylococcus aureus; identical to SEQ ID NO: 30740
  subsp. aureus CIG1612

SEQ ID NO: 37504 - protein, 241 aa, Staphylococcus aureus; identical to SEQ ID NO: 30739
  subsp. aureus CIG1612

SEQ ID NO: 37505 - protein, 241 aa, Staphylococcus aureus; identical to SEQ ID NO: 30738
  subsp. aureus CIG1612

SEQ ID NO: 37506 - protein, 372 aa, Staphylococcus aureus; identical to SEQ ID NO: 31084
  subsp. aureus CIG1612

SEQ ID NO: 37507 - protein, 923 aa, Staphylococcus aureus; identical to SEQ ID NO: 31930
  subsp. aureus CIG1612

SEQ ID NO: 37508 - protein, 1227 aa, Staphylococcus aureus
  subsp. aureus CIG1612
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 37509 - protein, 1154 aa, Staphylococcus aureus; identical to SEQ ID NO: 31977
  subsp. aureus CIG1612

SEQ ID NO: 37510 - protein, 434 aa, Staphylococcus aureus [sequence omitted]

SEQ ID NO: 37511 - protein, 933 aa, Staphylococcus aureus; identical to SEQ ID NO: 30755
  subsp. aureus CIG1612

SEQ ID NO: 37512 - protein, 242 aa, Staphylococcus aureus; identical to SEQ ID NO: 30536
  subsp. aureus CIG1612

SEQ ID NO: 37513 - protein, 231 aa, Staphylococcus aureus; identical to SEQ ID NO: 36718
  subsp. aureus CIG1612

SEQ ID NO: 37514 - protein, 250 aa, Staphylococcus aureus; identical to SEQ ID NO: 31910
  subsp. aureus CIG1612

SEQ ID NO: 37515 - protein, 266 aa, Staphylococcus aureus; identical to SEQ ID NO: 30401
  subsp. aureus CIG1612

SEQ ID NO: 37516 - protein, 291 aa, Staphylococcus aureus; identical to SEQ ID NO: 30390
  subsp. aureus CIG1612

SEQ ID NO: 37517 - protein, 895 aa, Staphylococcus aureus; identical to SEQ ID NO: 30734
  subsp. aureus CIG1612

SEQ ID NO: 37518 - protein, 2186 aa, Staphylococcus aureus; identical to SEQ ID NO: 33090
  subsp. aureus CIG1612

SEQ ID NO: 37519 - protein, 645 aa, Staphylococcus aureus; identical to SEQ ID NO: 30747
  subsp. aureus CIG1612

SEQ ID NO: 37520 - protein, 350 aa, Staphylococcus aureus; identical to SEQ ID NO: 30602
  subsp. aureus CIG1612

SEQ ID NO: 37521 - protein, 331 aa, Staphylococcus aureus; identical to SEQ ID NO: 30732
  subsp. aureus CIG1612

SEQ ID NO: 37522 - protein, 327 aa, Staphylococcus aureus; identical to SEQ ID NO: 30538
  subsp. aureus CIG1612

SEQ ID NO: 37523 - protein, 311 aa, Staphylococcus aureus; identical to SEQ ID NO: 30617
  subsp. aureus CIG1612

SEQ ID NO: 37524 - protein, 257 aa, Staphylococcus aureus; identical to SEQ ID NO: 30259
  subsp. aureus CIG1612

SEQ ID NO: 37525 - protein, 274 aa, Staphylococcus aureus; identical to SEQ ID NO: 30872
  subsp. aureus CIG1612

SEQ ID NO: 37526 - protein, 338 aa, Staphylococcus aureus; identical to SEQ ID NO: 30699
  subsp. aureus CIG1612

SEQ ID NO: 37527 - protein, 351 aa, Staphylococcus aureus; identical to SEQ ID NO: 30720
  subsp. aureus CIG1612

SEQ ID NO: 37528 - protein, 44 aa, Staphylococcus aureus; identical to SEQ ID NO: 30513
  subsp. aureus CIG1612

SEQ ID NO: 37529 - protein, 231 aa, Staphylococcus aureus; identical to SEQ ID NO: 31073
  subsp. aureus CIG1612

SEQ ID NO: 37530 - protein, 2478 aa, Staphylococcus aureus; identical to SEQ ID NO: 36745
  subsp. aureus CIG1612

SEQ ID NO: 37531 - protein, 2253 aa, Staphylococcus aureus
  subsp. aureus CIG1750
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 37532 - protein, 681 aa, Staphylococcus aureus; identical to SEQ ID NO: 30598
  subsp. aureus CIG1750

SEQ ID NO: 37533 - protein, 792 aa, Staphylococcus aureus
  subsp. aureus CIG1750
MAGVITLNGGEFRSIDKHQIAVADTNVQTPDYEKLRNTWLDVNYGYDKYDEKNDAMKKKFDATEKEAEKLLSSMKTESGRTYLWDSAKDLDNKSADMTRTYRNIEKIAEAMRHPKTTLNTDENKKKVKDALEWLHKNAYGKEPDNKVKELTENFKITDSSKKKALNWWDYEIGTPRSLTNTLILLNDQFSNEEKKKFTAPIKTFAPKSDEILSSVGKAEPAKGGNLVDIAKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDDSTKAKYKKIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSNSTQTFDINNTKVEVKAKGMFILKNKDDNTYECSFYNPESTNTASDIESKISITGYSITNKNTSTSNESGVHFELTK

SEQ ID NO: 37534 - protein, 141 aa, Staphylococcus aureus; identical to SEQ ID NO: 30633
  subsp. aureus CIG1750

SEQ ID NO: 37535 - protein, 309 aa, Staphylococcus aureus; identical to SEQ ID NO: 30406
  subsp. aureus CIG1750

SEQ ID NO: 37536 - protein, 315 aa, Staphylococcus aureus; identical to SEQ ID NO: 30573
  subsp. aureus CIG1750

SEQ ID NO: 37537 - protein, 325 aa, Staphylococcus aureus; identical to SEQ ID NO: 30407
  subsp. aureus CIG1750

SEQ ID NO: 37538 - protein, 938 aa, Staphylococcus aureus; identical to SEQ ID NO: 30838
  subsp. aureus CIG1750

SEQ ID NO: 37539 - protein, 1015 aa, Staphylococcus aureus; identical to SEQ ID NO: 30839
  subsp. aureus CIG1750

SEQ ID NO: 37540 - protein, 233 aa, Staphylococcus aureus; identical to SEQ ID NO: 30591
  subsp. aureus CIG1750

SEQ ID NO: 37541 - protein, 211 aa, Staphylococcus aureus; identical to SEQ ID NO: 30592
  subsp. aureus CIG1750

SEQ ID NO: 37542 - protein, 870 aa, Staphylococcus aureus
  subsp. aureus CIG1750
MSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 37543 - protein, 508 aa, Staphylococcus aureus; identical to SEQ ID NO: 30782
  subsp. aureus CIG1750

SEQ ID NO: 37544 - protein, 241 aa, Staphylococcus aureus; identical to SEQ ID NO: 30571
  subsp. aureus CIG1750

SEQ ID NO: 37545 - protein, 965 aa, Staphylococcus aureus; identical to SEQ ID NO: 30920
  subsp. aureus CIG1750

SEQ ID NO: 37546 - protein, 1337 aa, Staphylococcus aureus; identical to SEQ ID NO: 30811
  subsp. aureus CIG1750

SEQ ID NO: 37547 - protein, 1153 aa, Staphylococcus aureus; identical to SEQ ID NO: 30596
  subsp. aureus CIG1750

SEQ ID NO: 37548 - protein, 434 aa, Staphylococcus aureus [sequence omitted]

SEQ ID NO: 37549 - protein, 905 aa, Staphylococcus aureus; identical to SEQ ID NO: 30600
  subsp. aureus CIG1750

SEQ ID NO: 37550 - protein, 645 aa, Staphylococcus aureus; identical to SEQ ID NO: 30601
  subsp. aureus CIG1750

SEQ ID NO: 37551 - protein, 350 aa, Staphylococcus aureus; identical to SEQ ID NO: 30602
  subsp. aureus CIG1750

SEQ ID NO: 37552 - protein, 109 aa, Staphylococcus aureus; identical to SEQ ID NO: 30603
  subsp. aureus CIG1750

SEQ ID NO: 37553 - protein, 165 aa, Staphylococcus aureus; identical to SEQ ID NO: 30418
  subsp. aureus CIG1750

SEQ ID NO: 37554 - protein, 319 aa, Staphylococcus aureus; identical to SEQ ID NO: 30605
  subsp. aureus CIG1750

SEQ ID NO: 37555 - protein, 238 aa, Staphylococcus aureus; identical to SEQ ID NO: 30606
  subsp. aureus CIG1750

SEQ ID NO: 37556 - protein, 241 aa, Staphylococcus aureus; identical to SEQ ID NO: 30607
  subsp. aureus CIG1750

SEQ ID NO: 37557 - protein, 241 aa, Staphylococcus aureus; identical to SEQ ID NO: 30608
  subsp. aureus CIG1750

SEQ ID NO: 37558 - protein, 372 aa, Staphylococcus aureus; identical to SEQ ID NO: 30609
  subsp. aureus CIG1750

SEQ ID NO: 37559 - protein, 227 aa, Staphylococcus aureus; identical to SEQ ID NO: 30586
  subsp. aureus CIG1750

SEQ ID NO: 37560 - protein, 227 aa, Staphylococcus aureus; identical to SEQ ID NO: 30585
  subsp. aureus CIG1750

SEQ ID NO: 37561 - protein, 232 aa, Staphylococcus aureus; identical to SEQ ID NO: 30584
  subsp. aureus CIG1750

SEQ ID NO: 37562 - protein, 232 aa, Staphylococcus aureus; identical to SEQ ID NO: 30583
  subsp. aureus CIG1750

SEQ ID NO: 37563 - protein, 231 aa, Staphylococcus aureus; identical to SEQ ID NO: 30582
  subsp. aureus CIG1750

SEQ ID NO: 37564 - protein, 234 aa, Staphylococcus aureus; identical to SEQ ID NO: 30581
  subsp. aureus CIG1750

SEQ ID NO: 37565 - protein, 292 aa, Staphylococcus aureus; identical to SEQ ID NO: 30580
  subsp. aureus CIG1750

SEQ ID NO: 37566 - protein, 356 aa, Staphylococcus aureus; identical to SEQ ID NO: 30579
  subsp. aureus CIG1750

SEQ ID NO: 37567 - protein, 231 aa, Staphylococcus aureus; identical to SEQ ID NO: 30578
  subsp. aureus CIG1750

SEQ ID NO: 37568 - protein, 226 aa, Staphylococcus aureus; identical to SEQ ID NO: 30577
  subsp. aureus CIG1750

SEQ ID NO: 37569 - protein, 203 aa, Staphylococcus aureus; identical to SEQ ID NO: 30576
  subsp. aureus CIG1750

SEQ ID NO: 37570 - protein, 62 aa, Staphylococcus aureus; identical to SEQ ID NO: 30610
  subsp. aureus CIG1750

SEQ ID NO: 37571 - protein, 138 aa, Staphylococcus aureus; identical to SEQ ID NO: 30785
  subsp. aureus CIG1750

SEQ ID NO: 37572 - protein, 291 aa, Staphylococcus aureus
  subsp. aureus CIG1750
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDNTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 37573 - protein, 891 aa, Staphylococcus aureus
  subsp. aureus CIG1750
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVHELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 37574 - protein, 2186 aa, Staphylococcus aureus; identical to SEQ ID NO: 30789
  subsp. aureus CIG1750

SEQ ID NO: 37575 - protein, 331 aa, Staphylococcus aureus; identical to SEQ ID NO: 30615
  subsp. aureus CIG1750

SEQ ID NO: 37576 - protein, 327 aa, Staphylococcus aureus; identical to SEQ ID NO: 30616
  subsp. aureus CIG1750

SEQ ID NO: 37577 - protein, 306 aa, Staphylococcus aureus
  subsp. aureus CIG1750
MLDATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 37578 - protein, 258 aa, Staphylococcus aureus; identical to SEQ ID NO: 30410
  subsp. aureus CIG1750

SEQ ID NO: 37579 - protein, 251 aa, Staphylococcus aureus; identical to SEQ ID NO: 30946
  subsp. aureus CIG1750

SEQ ID NO: 37580 - protein, 131 aa, Staphylococcus aureus; identical to SEQ ID NO: 30867
  subsp. aureus CIG1750

SEQ ID NO: 37581 - protein, 242 aa, Staphylococcus aureus; identical to SEQ ID NO: 30399
  subsp. aureus CIG1750

SEQ ID NO: 37582 - protein, 181 aa, Staphylococcus aureus; identical to SEQ ID NO: 36678
  subsp. aureus CIG1750

SEQ ID NO: 37583 - protein, 254 aa, Staphylococcus aureus; identical to SEQ ID NO: 30809
  subsp. aureus CIG1750

SEQ ID NO: 37584 - protein, 242 aa, Staphylococcus aureus; identical to SEQ ID NO: 30814
  subsp. aureus CIG1750

SEQ ID NO: 37585 - protein, 274 aa, Staphylococcus aureus; identical to SEQ ID NO: 30815
  subsp. aureus CIG1750

SEQ ID NO: 37586 - protein, 338 aa, Staphylococcus aureus; identical to SEQ ID NO: 30627
  subsp. aureus CIG1750

SEQ ID NO: 37587 - protein, 351 aa, Staphylococcus aureus; identical to SEQ ID NO: 30628
  subsp. aureus CIG1750

SEQ ID NO: 37588 - protein, 44 aa, Staphylococcus aureus; identical to SEQ ID NO: 30513
  subsp. aureus CIG1750

SEQ ID NO: 37589 - protein, 231 aa, Staphylococcus aureus; identical to SEQ ID NO: 30630
  subsp. aureus CIG1750

SEQ ID NO: 37590 - protein, 2481 aa, Staphylococcus aureus
  subsp. aureus CIG1750
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATAEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 37591 - protein, 274 aa, Staphylococcus aureus; identical to SEQ ID NO: 30815
  subsp. aureus CIG1769

SEQ ID NO: 37592 - protein, 338 aa, Staphylococcus aureus; identical to SEQ ID NO: 30627
  subsp. aureus CIG1769

SEQ ID NO: 37593 - protein, 351 aa, Staphylococcus aureus; identical to SEQ ID NO: 30628
  subsp. aureus CIG1769

SEQ ID NO: 37594 - protein, 44 aa, Staphylococcus aureus; identical to SEQ ID NO: 30513
  subsp. aureus CIG1769

SEQ ID NO: 37595 - protein, 809 aa, Staphylococcus aureus; identical to SEQ ID NO: 30632
  subsp. aureus CIG1769

SEQ ID NO: 37596 - protein, 141 aa, Staphylococcus aureus; identical to SEQ ID NO: 30633
  subsp. aureus CIG1769

SEQ ID NO: 37597 - protein, 309 aa, Staphylococcus aureus; identical to SEQ ID NO: 30406
  subsp. aureus CIG1769

SEQ ID NO: 37598 - protein, 315 aa, Staphylococcus aureus; identical to SEQ ID NO: 30573
  subsp. aureus CIG1769

SEQ ID NO: 37599 - protein, 325 aa, Staphylococcus aureus; identical to SEQ ID NO: 30407
  subsp. aureus CIG1769

SEQ ID NO: 37600 - protein, 859 aa, Staphylococcus aureus; identical to SEQ ID NO: 36568
  subsp. aureus CIG1769

SEQ ID NO: 37601 - protein, 910 aa, Staphylococcus aureus; identical to SEQ ID NO: 35225
  subsp. aureus CIG1769

SEQ ID NO: 37602 - protein, 1015 aa, Staphylococcus aureus
  subsp. aureus CIG1769
MIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGIETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 37603 - protein, 233 aa, Staphylococcus aureus; identical to SEQ ID NO: 30591
  subsp. aureus CIG1769

SEQ ID NO: 37604 - protein, 211 aa, Staphylococcus aureus; identical to SEQ ID NO: 30592
  subsp. aureus CIG1769

SEQ ID NO: 37605 - protein, 877 aa, Staphylococcus aureus; identical to SEQ ID NO: 30593
  subsp. aureus CIG1769

SEQ ID NO: 37606 - protein, 2271 aa, Staphylococcus aureus; identical to SEQ ID NO: 30597
  subsp. aureus CIG1769

SEQ ID NO: 37607 - protein, 681 aa, Staphylococcus aureus; identical to SEQ ID NO: 30598
  subsp. aureus CIG1769

SEQ ID NO: 37608 - protein, 508 aa, Staphylococcus aureus; identical to SEQ ID NO: 30782
  subsp. aureus CIG1769

SEQ ID NO: 37609 - protein, 241 aa, Staphylococcus aureus; identical to SEQ ID NO: 30571
  subsp. aureus CIG1769

SEQ ID NO: 37610 - protein, 691 aa, Staphylococcus aureus; identical to SEQ ID NO: 30511
  subsp. aureus CIG1769

SEQ ID NO: 37611 - protein, 203 aa, Staphylococcus aureus; identical to SEQ ID NO: 30576
  subsp. aureus CIG1769

SEQ ID NO: 37612 - protein, 226 aa, Staphylococcus aureus; identical to SEQ ID NO: 30577
  subsp. aureus CIG1769

SEQ ID NO: 37613 - protein, 231 aa, Staphylococcus aureus; identical to SEQ ID NO: 30578
  subsp. aureus CIG1769

SEQ ID NO: 37614 - protein, 356 aa, Staphylococcus aureus; identical to SEQ ID NO: 30579
  subsp. aureus CIG1769

SEQ ID NO: 37615 - protein, 292 aa, Staphylococcus aureus; identical to SEQ ID NO: 30580
  subsp. aureus CIG1769

SEQ ID NO: 37616 - protein, 234 aa, Staphylococcus aureus; identical to SEQ ID NO: 30581
  subsp. aureus CIG1769

SEQ ID NO: 37617 - protein, 231 aa, Staphylococcus aureus; identical to SEQ ID NO: 30582
  subsp. aureus CIG1769

SEQ ID NO: 37618 - protein, 232 aa, Staphylococcus aureus; identical to SEQ ID NO: 30583
  subsp. aureus CIG1769

SEQ ID NO: 37619 - protein, 232 aa, Staphylococcus aureus; identical to SEQ ID NO: 30584
  subsp. aureus CIG1769

SEQ ID NO: 37620 - protein, 227 aa, Staphylococcus aureus; identical to SEQ ID NO: 30585
  subsp. aureus CIG1769

SEQ ID NO: 37621 - protein, 227 aa, Staphylococcus aureus; identical to SEQ ID NO: 30586
  subsp. aureus CIG1769

SEQ ID NO: 37622 - protein, 965 aa, Staphylococcus aureus; identical to SEQ ID NO: 30920
  subsp. aureus CIG1769

SEQ ID NO: 37623 - protein, 1337 aa, Staphylococcus aureus; identical to SEQ ID NO: 30811
  subsp. aureus CIG1769

SEQ ID NO: 37624 - protein, 1153 aa, Staphylococcus aureus; identical to SEQ ID NO: 30596
  subsp. aureus CIG1769

SEQ ID NO: 37625 - protein, 434 aa, Staphylococcus aureus [sequence omitted]

SEQ ID NO: 37626 - protein, 905 aa, Staphylococcus aureus; identical to SEQ ID NO: 30600
  subsp. aureus CIG1769

SEQ ID NO: 37627 - protein, 645 aa, Staphylococcus aureus; identical to SEQ ID NO: 30601
  subsp. aureus CIG1769

SEQ ID NO: 37628 - protein, 350 aa, Staphylococcus aureus; identical to SEQ ID NO: 30602
  subsp. aureus CIG1769

SEQ ID NO: 37629 - protein, 109 aa, Staphylococcus aureus; identical to SEQ ID NO: 30603
  subsp. aureus CIG1769

SEQ ID NO: 37630 - protein, 165 aa, Staphylococcus aureus; identical to SEQ ID NO: 30418
  subsp. aureus CIG1769

SEQ ID NO: 37631 - protein, 319 aa, Staphylococcus aureus; identical to SEQ ID NO: 30605
  subsp. aureus CIG1769

SEQ ID NO: 37632 - protein, 238 aa, Staphylococcus aureus; identical to SEQ ID NO: 30606
  subsp. aureus CIG1769

SEQ ID NO: 37633 - protein, 241 aa, Staphylococcus aureus; identical to SEQ ID NO: 30607
  subsp. aureus CIG1769

SEQ ID NO: 37634 - protein, 241 aa, Staphylococcus aureus; identical to SEQ ID NO: 30608
  subsp. aureus CIG1769

SEQ ID NO: 37635 - protein, 372 aa, Staphylococcus aureus; identical to SEQ ID NO: 30609
  subsp. aureus CIG1769

SEQ ID NO: 37636 - protein, 62 aa, Staphylococcus aureus; identical to SEQ ID NO: 30610
  subsp. aureus CIG1769

SEQ ID NO: 37637 - protein, 138 aa, Staphylococcus aureus; identical to SEQ ID NO: 30785
  subsp. aureus CIG1769

SEQ ID NO: 37638 - protein, 291 aa, Staphylococcus aureus; identical to SEQ ID NO: 30390
  subsp. aureus CIG1769

SEQ ID NO: 37639 - protein, 891 aa, Staphylococcus aureus; identical to SEQ ID NO: 30788
  subsp. aureus CIG1769

SEQ ID NO: 37640 - protein, 2186 aa, Staphylococcus aureus; identical to SEQ ID NO: 30789
  subsp. aureus CIG1769

SEQ ID NO: 37641 - protein, 331 aa, Staphylococcus aureus; identical to SEQ ID NO: 30615
  subsp. aureus CIG1769

SEQ ID NO: 37642 - protein, 327 aa, Staphylococcus aureus; identical to SEQ ID NO: 30616
  subsp. aureus CIG1769

SEQ ID NO: 37643 - protein, 311 aa, Staphylococcus aureus; identical to SEQ ID NO: 30617
  subsp. aureus CIG1769

SEQ ID NO: 37644 - protein, 258 aa, Staphylococcus aureus; identical to SEQ ID NO: 30410
  subsp. aureus CIG1769

SEQ ID NO: 37645 - protein, 165 aa, Staphylococcus aureus; identical to SEQ ID NO: 30805
  subsp. aureus CIG1769

SEQ ID NO: 37646 - protein, 37 aa, Staphylococcus aureus; identical to SEQ ID NO: 30806
  subsp. aureus CIG1769

SEQ ID NO: 37647 - protein, 242 aa, Staphylococcus aureus; identical to SEQ ID NO: 30399
  subsp. aureus CIG1769

SEQ ID NO: 37648 - protein, 239 aa, Staphylococcus aureus; identical to SEQ ID NO: 30622
  subsp. aureus CIG1769

SEQ ID NO: 37649 - protein, 254 aa, Staphylococcus aureus; identical to SEQ ID NO: 30809
  subsp. aureus CIG1769

SEQ ID NO: 37650 - protein, 96 aa, Staphylococcus aureus; identical to SEQ ID NO: 30813
  subsp. aureus CIG1769

SEQ ID NO: 37651 - protein, 242 aa, Staphylococcus aureus; identical to SEQ ID NO: 30814
  subsp. aureus CIG1769

SEQ ID NO: 37652 - protein, 2481 aa, Staphylococcus aureus; identical to SEQ ID NO: 30631
  subsp. aureus CIG1769

SEQ ID NO: 37653 - protein, 231 aa, Staphylococcus aureus; identical to SEQ ID NO: 30630
  subsp. aureus CIG1769

SEQ ID NO: 37654 - protein, 241 aa, Staphylococcus aureus; identical to SEQ ID NO: 30776
  subsp. aureus CIG1770

SEQ ID NO: 37655 - protein, 508 aa, Staphylococcus aureus; identical to SEQ ID NO: 34278
  subsp. aureus CIG1770

SEQ ID NO: 37656 - protein, 807 aa, Staphylococcus aureus; identical to SEQ ID NO: 30716
  subsp. aureus CIG1770

SEQ ID NO: 37657 - protein, 141 aa, Staphylococcus aureus; identical to SEQ ID NO: 30715
  subsp. aureus CIG1770

SEQ ID NO: 37658 - protein, 309 aa, Staphylococcus aureus; identical to SEQ ID NO: 30406
  subsp. aureus CIG1770

SEQ ID NO: 37659 - protein, 315 aa, Staphylococcus aureus; identical to SEQ ID NO: 30440
  subsp. aureus CIG1770

SEQ ID NO: 37660 - protein, 325 aa, Staphylococcus aureus; identical to SEQ ID NO: 30407
  subsp. aureus CIG1770

SEQ ID NO: 37661 - protein, 191 aa, Staphylococcus aureus; identical to SEQ ID NO: 36699
  subsp. aureus CIG1770

SEQ ID NO: 37662 - protein, 444 aa, Staphylococcus aureus; identical to SEQ ID NO: 32034
  subsp. aureus CIG1770

SEQ ID NO: 37663 - protein, 931 aa, Staphylococcus aureus; identical to SEQ ID NO: 36701
  subsp. aureus CIG1770

SEQ ID NO: 37664 - protein, 995 aa, Staphylococcus aureus; identical to SEQ ID NO: 31038
  subsp. aureus CIG1770

SEQ ID NO: 37665 - protein, 233 aa, Staphylococcus aureus; identical to SEQ ID NO: 30428
  subsp. aureus CIG1770

SEQ ID NO: 37666 - protein, 879 aa, Staphylococcus aureus; identical to SEQ ID NO: 36689
  subsp. aureus CIG1770

SEQ ID NO: 37667 - protein, 1503 aa, Staphylococcus aureus; identical to SEQ ID NO: 33069
  subsp. aureus CIG1770

SEQ ID NO: 37668 - protein, 681 aa, Staphylococcus aureus; identical to SEQ ID NO: 32025
  subsp. aureus CIG1770

SEQ ID NO: 37669 - protein, 226 aa, Staphylococcus aureus; identical to SEQ ID NO: 30769
  subsp. aureus CIG1770

SEQ ID NO: 37670 - protein, 231 aa, Staphylococcus aureus; identical to SEQ ID NO: 30768
  subsp. aureus CIG1770

SEQ ID NO: 37671 - protein, 67 aa, Staphylococcus aureus; identical to SEQ ID NO: 36707
  subsp. aureus CIG1770

SEQ ID NO: 37672 - protein, 234 aa, Staphylococcus aureus; identical to SEQ ID NO: 31052
  subsp. aureus CIG1770

SEQ ID NO: 37673 - protein, 231 aa, Staphylococcus aureus; identical to SEQ ID NO: 31761
  subsp. aureus CIG1770

SEQ ID NO: 37674 - protein, 231 aa, Staphylococcus aureus; identical to SEQ ID NO: 30560
  subsp. aureus CIG1770

SEQ ID NO: 37675 - protein, 232 aa, Staphylococcus aureus; identical to SEQ ID NO: 31054
  subsp. aureus CIG1770

SEQ ID NO: 37676 - protein, 232 aa, Staphylococcus aureus; identical to SEQ ID NO: 30765
  subsp. aureus CIG1770

SEQ ID NO: 37677 - protein, 227 aa, Staphylococcus aureus; identical to SEQ ID NO: 30585
  subsp. aureus CIG1770

SEQ ID NO: 37678 - protein, 225 aa, Staphylococcus aureus; identical to SEQ ID NO: 30763
  subsp. aureus CIG1770

SEQ ID NO: 37679 - protein, 690 aa, Staphylococcus aureus; identical to SEQ ID NO: 30419
  subsp. aureus CIG1770

SEQ ID NO: 37680 - protein, 203 aa, Staphylococcus aureus; identical to SEQ ID NO: 30770
  subsp. aureus CIG1770

SEQ ID NO: 37681 - protein, 109 aa, Staphylococcus aureus; identical to SEQ ID NO: 30744
  subsp. aureus CIG1770

SEQ ID NO: 37682 - protein, 165 aa, Staphylococcus aureus; identical to SEQ ID NO: 30742
  subsp. aureus CIG1770

SEQ ID NO: 37683 - protein, 319 aa, Staphylococcus aureus; identical to SEQ ID NO: 30741
  subsp. aureus CIG1770

SEQ ID NO: 37684 - protein, 238 aa, Staphylococcus aureus; identical to SEQ ID NO: 30740
  subsp. aureus CIG1770

SEQ ID NO: 37685 - protein, 241 aa, Staphylococcus aureus; identical to SEQ ID NO: 30739
  subsp. aureus CIG1770

SEQ ID NO: 37686 - protein, 241 aa, Staphylococcus aureus; identical to SEQ ID NO: 30738
  subsp. aureus CIG1770

SEQ ID NO: 37687 - protein, 434 aa, Staphylococcus aureus [sequence omitted]

SEQ ID NO: 37688 - protein, 933 aa, Staphylococcus aureus; identical to SEQ ID NO: 30755
  subsp. aureus CIG1770

SEQ ID NO: 37689 - protein, 242 aa, Staphylococcus aureus; identical to SEQ ID NO: 30536
  subsp. aureus CIG1770

SEQ ID NO: 37690 - protein, 231 aa, Staphylococcus aureus; identical to SEQ ID NO: 36718
  subsp. aureus CIG1770

SEQ ID NO: 37691 - protein, 372 aa, Staphylococcus aureus; identical to SEQ ID NO: 31084
  subsp. aureus CIG1770

SEQ ID NO: 37692 - protein, 250 aa, Staphylococcus aureus; identical to SEQ ID NO: 31910
  subsp. aureus CIG1770

SEQ ID NO: 37693 - protein, 291 aa, Staphylococcus aureus; identical to SEQ ID NO: 30390
  subsp. aureus CIG1770

SEQ ID NO: 37694 - protein, 929 aa, Staphylococcus aureus; identical to SEQ ID NO: 33226
  subsp. aureus CIG1770

SEQ ID NO: 37695 - protein, 1375 aa, Staphylococcus aureus; identical to SEQ ID NO: 36730
  subsp. aureus CIG1770

SEQ ID NO: 37696 - protein, 1148 aa, Staphylococcus aureus; identical to SEQ ID NO: 36731
  subsp. aureus CIG1770

SEQ ID NO: 37697 - protein, 266 aa, Staphylococcus aureus; identical to SEQ ID NO: 30401
  subsp. aureus CIG1770

SEQ ID NO: 37698 - protein, 2186 aa, Staphylococcus aureus; identical to SEQ ID NO: 33090
  subsp. aureus CIG1770

SEQ ID NO: 37699 - protein, 895 aa, Staphylococcus aureus; identical to SEQ ID NO: 36734
  subsp. aureus CIG1770

SEQ ID NO: 37700 - protein, 645 aa, Staphylococcus aureus; identical to SEQ ID NO: 30747
  subsp. aureus CIG1770

SEQ ID NO: 37701 - protein, 350 aa, Staphylococcus aureus; identical to SEQ ID NO: 30602
  subsp. aureus CIG1770

SEQ ID NO: 37702 - protein, 331 aa, Staphylococcus aureus; identical to SEQ ID NO: 30732
  subsp. aureus CIG1770

SEQ ID NO: 37703 - protein, 327 aa, Staphylococcus aureus; identical to SEQ ID NO: 30538
  subsp. aureus CIG1770

SEQ ID NO: 37704 - protein, 311 aa, Staphylococcus aureus; identical to SEQ ID NO: 30617
  subsp. aureus CIG1770

SEQ ID NO: 37705 - protein, 96 aa, Staphylococcus aureus; identical to SEQ ID NO: 30813
  subsp. aureus CIG1770

SEQ ID NO: 37706 - protein, 257 aa, Staphylococcus aureus; identical to SEQ ID NO: 30259
  subsp. aureus CIG1770

SEQ ID NO: 37707 - protein, 274 aa, Staphylococcus aureus; identical to SEQ ID NO: 30872
  subsp. aureus CIG1770

SEQ ID NO: 37708 - protein, 338 aa, Staphylococcus aureus; identical to SEQ ID NO: 30699
  subsp. aureus CIG1770

SEQ ID NO: 37709 - protein, 351 aa, Staphylococcus aureus; identical to SEQ ID NO: 30720
  subsp. aureus CIG1770

SEQ ID NO: 37710 - protein, 44 aa, Staphylococcus aureus; identical to SEQ ID NO: 30513
  subsp. aureus CIG1770

SEQ ID NO: 37711 - protein, 231 aa, Staphylococcus aureus; identical to SEQ ID NO: 31073
  subsp. aureus CIG1770

SEQ ID NO: 37712 - protein, 2478 aa, Staphylococcus aureus; identical to SEQ ID NO: 36745
  subsp. aureus CIG1770

SEQ ID NO: 37713 - protein, 662 aa, Staphylococcus aureus
  subsp. aureus CIG1835
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTG

SEQ ID NO: 37714 - protein, 920 aa, Staphylococcus aureus
  subsp. aureus CIG1835
MIVVGMGQEKEAAASEQNNTTVEESGSSATERKASETQTTTNNVNTIDETQSYSATSTEQPSQSTQVTTEEAPTTVQAPKVETSRVDLPSEKVADKETTGTQVDTAQPSNVSEIKPRMKRSTDVTAVTEKEVVEEAKATGTDVTSKVEVEEGSEIVGHNNKETNVVNPHNAERVTLKYKWKFEDGIKPGDYFDFTLSNNVETHGISPLRKVPDIKSKDDNILAVGKVMDERKIRYTFTDYINNKNNLMAELNLNLFIDPTTVTKQGKQTVEVKLGENKISKEFDIKYLDGVKDNWGVTVNGRITLLDKENSKIHHLAYINPKKSDMTSITINGFFAKGGLYTGNVPTVKVYEYLRSDELPESVYANTNDQEKFKDVTNDMSDKLTLSENGSYKLTLDALNKKSYVVSFEGKYNENDKELLFRTNLHGYHANYGYYYYYPVSLTWDNGVAFYSNNAQGDGKDKPNDPIIEKSEPIELDIKSEPPVEKHELTGTIEESNDSKPIDFEYHTAVEGVEGHAEGIIETEEDSIHVDFEESTHENSKHHADVVEYEEDTNPGGGQVITESNLVEFDEESTKGILTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNSVDFEEDTLPQVSGHNEGQQTIEEDTTLPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGILFGGLFSILGFALLRRNKKNHKA

SEQ ID NO: 37715 - protein, 987 aa, Staphylococcus aureus
  subsp. aureus CIG1835
MGQDKEAAASEQKTTTVEENGNSATENKVNETQTTTTNVNTIDETQSYSATATEQPSNATQVTTEEAPKAVQAPQTAQPANLETVKEEVVKEEAKPQVKETTQSQDNSGDQRQVDLTPKKATQNQVAETQVEVAQPRTASESKPRVTRSADVVEAKEASDEKVETGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQNNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHTEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 37716 - protein, 233 aa, Staphylococcus aureus; identical to SEQ ID NO: 30428
  subsp. aureus CIG1835

SEQ ID NO: 37717 - protein, 198 aa, Staphylococcus aureus; identical to SEQ ID NO: 31544
  subsp. aureus CIG1835

SEQ ID NO: 37718 - protein, 799 aa, Staphylococcus aureus
  subsp. aureus CIG1835
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDKTGKNLKTQVIQENVDPATGKDYSIFGWNNENVVRYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSDSESDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 37719 - protein, 2275 aa, Staphylococcus aureus; identical to SEQ ID NO: 31542
  subsp. aureus CIG1835

SEQ ID NO: 37720 - protein, 681 aa, Staphylococcus aureus; identical to SEQ ID NO: 32025
  subsp. aureus CIG1835

SEQ ID NO: 37721 - protein, 809 aa, Staphylococcus aureus
  subsp. aureus CIG1835
MNKNVLKFMVFIMLLNIITPLFNKNEALAARDISSTNVTDLTVSPTKIEDGGKTTVKMTFDDKSVKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNTEKPIETTSISGEKVWDDKDNQDGKRPEKVSVNLLANGEKVKAVDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 37722 - protein, 241 aa, Staphylococcus aureus; identical to SEQ ID NO: 30411
  subsp. aureus CIG1835

SEQ ID NO: 37723 - protein, 492 aa, Staphylococcus aureus; identical to SEQ ID NO: 31351
  subsp. aureus CIG1835

SEQ ID NO: 37724 - protein, 241 aa, Staphylococcus aureus; identical to SEQ ID NO: 31350
  subsp. aureus CIG1835

SEQ ID NO: 37725 - protein, 1795 aa, Staphylococcus aureus
  subsp. aureus CIG1835
MNLFRQQKFSIRKFNVGIFSALIATVTFISINPTTASAAEQNQPAQNQPAQPADANAQPNANAGAQANPAAQPAAPANQGQPAAQPANQGGQANPAGGAAQPVGGAAQPAAGTAQPAGQGNQADPNNAAQAQPGNQAAPANQAGQGNNQATPANQTQPANAPAAQPAAPVAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYINDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVEAAQKQGLHDIQVVKSKQEVADTKSKVLDKINAIQTQAKVKPAADTEVENAYNTRKQEIQNSNASTTEEKQAAYTELDTKKQEARTNLDAANTNSAVTTAKDNGIAAINQVQAATTKKSDAKAEIAQKASERKTAIEAMNDSTTEEQQAAKEKVDQAVLSANADIDNAAANTDVDNAKTTNEATIAAITPDANVKPQAKQAIADKVQAQEKAIDANNGSTTEEKAAAKQQVQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKAIQAIAAATTNAQVDEAKTNAEAAINAVTPKVVKKQTAKDEIDQLQATQTNVINNDQNATTEEKEAAIQQLATAVTDAKNNITAATDDNGVDQAKDAGKNSIQSTQPATSVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADANATQDEKQ

SEQ ID NO: 37726 - protein, 690 aa, Staphylococcus aureus; identical to SEQ ID NO: 31345
  subsp. aureus CIG1835

SEQ ID NO: 37727 - protein, 203 aa, Staphylococcus aureus; identical to SEQ ID NO: 31344
  subsp. aureus CIG1835

SEQ ID NO: 37728 - protein, 226 aa, Staphylococcus aureus; identical to SEQ ID NO: 31343
  subsp. aureus CIG1835

SEQ ID NO: 37729 - protein, 231 aa, Staphylococcus aureus; identical to SEQ ID NO: 31342
  subsp. aureus CIG1835

SEQ ID NO: 37730 - protein, 356 aa, Staphylococcus aureus; identical to SEQ ID NO: 31598
  subsp. aureus CIG1835

SEQ ID NO: 37731 - protein, 315 aa, Staphylococcus aureus; identical to SEQ ID NO: 31340
  subsp. aureus CIG1835

SEQ ID NO: 37732 - protein, 234 aa, Staphylococcus aureus; identical to SEQ ID NO: 31339
  subsp. aureus CIG1835

SEQ ID NO: 37733 - protein, 232 aa, Staphylococcus aureus; identical to SEQ ID NO: 31338
  subsp. aureus CIG1835

SEQ ID NO: 37734 - protein, 231 aa, Staphylococcus aureus; identical to SEQ ID NO: 31337
  subsp. aureus CIG1835

SEQ ID NO: 37735 - protein, 232 aa, Staphylococcus aureus; identical to SEQ ID NO: 31593
  subsp. aureus CIG1835

SEQ ID NO: 37736 - protein, 232 aa, Staphylococcus aureus; identical to SEQ ID NO: 31335
  subsp. aureus CIG1835

SEQ ID NO: 37737 - protein, 227 aa, Staphylococcus aureus; identical to SEQ ID NO: 31334
  subsp. aureus CIG1835

SEQ ID NO: 37738 - protein, 230 aa, Staphylococcus aureus; identical to SEQ ID NO: 31333
  subsp. aureus CIG1835

SEQ ID NO: 37739 - protein, 434 aa, Staphylococcus aureus [sequence omitted]

SEQ ID NO: 37740 - protein, 266 aa, Staphylococcus aureus; identical to SEQ ID NO: 31585
  subsp. aureus CIG1835

SEQ ID NO: 37741 - protein, 240 aa, Staphylococcus aureus; identical to SEQ ID NO: 31584
  subsp. aureus CIG1835

SEQ ID NO: 37742 - protein, 946 aa, Staphylococcus aureus; identical to SEQ ID NO: 31583
  subsp. aureus CIG1835

SEQ ID NO: 37743 - protein, 645 aa, Staphylococcus aureus; identical to SEQ ID NO: 30747
  subsp. aureus CIG1835

SEQ ID NO: 37744 - protein, 350 aa, Staphylococcus aureus; identical to SEQ ID NO: 30602
  subsp. aureus CIG1835

SEQ ID NO: 37745 - protein, 105 aa, Staphylococcus aureus; identical to SEQ ID NO: 31317
  subsp. aureus CIG1835

SEQ ID NO: 37746 - protein, 165 aa, Staphylococcus aureus; identical to SEQ ID NO: 31315
  subsp. aureus CIG1835

SEQ ID NO: 37747 - protein, 319 aa, Staphylococcus aureus; identical to SEQ ID NO: 30495
  subsp. aureus CIG1835

SEQ ID NO: 37748 - protein, 238 aa, Staphylococcus aureus; identical to SEQ ID NO: 31313
  subsp. aureus CIG1835

SEQ ID NO: 37749 - protein, 241 aa, Staphylococcus aureus; identical to SEQ ID NO: 30739
  subsp. aureus CIG1835

SEQ ID NO: 37750 - protein, 241 aa, Staphylococcus aureus; identical to SEQ ID NO: 31311
  subsp. aureus CIG1835

SEQ ID NO: 37751 - protein, 372 aa, Staphylococcus aureus; identical to SEQ ID NO: 30609
  subsp. aureus CIG1835

SEQ ID NO: 37752 - protein, 309 aa, Staphylococcus aureus; identical to SEQ ID NO: 30406
  subsp. aureus CIG1835

SEQ ID NO: 37753 - protein, 315 aa, Staphylococcus aureus; identical to SEQ ID NO: 30573
  subsp. aureus CIG1835

SEQ ID NO: 37754 - protein, 323 aa, Staphylococcus aureus
  subsp. aureus CIG1835
MNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 37755 - protein, 291 aa, Staphylococcus aureus
  subsp. aureus CIG1835
FNPKLQPGEERVKQEGQPGSKTITTPITVNPLTGEKVGEGQPTEEITKQPIDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 37756 - protein, 961 aa, Staphylococcus aureus
  subsp. aureus CIG1835
MNNKKTVTNRKGMIPNRLNKFSIRKYSVGTASILVGTTLIFGLSGHEAKAAEHTNGELNQSKNETTAPSENKTTEKVDSHQLKDNTQTATADQPKVTMSDSATFKETSSNMQSPQNATASQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVSLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTNQFNITYSNDNKTATVDLMNGQTSSNKQYIIQQVAYPDNTSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTDSDSDSDSDSDSDSDSDSDSDSDSDSDSDSDSDSDSDSDSDSDSDSDSDSESDADSDTDSDSDAGKHTPAKPMSTVKDQHKTAKALPETGSENNNSNNGTLFGGLFAALGSLLLFGRRKKQNK

SEQ ID NO: 37757 - protein, 1347 aa, Staphylococcus aureus
  subsp. aureus CIG1835
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRIAAVQPSSTEAKNVNDLITSNTTLTVVDADKNNKIVPAQDYLELKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYINPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 37758 - protein, 1141 aa, Staphylococcus aureus; identical to SEQ ID NO: 31329
  subsp. aureus CIG1835

SEQ ID NO: 37759 - protein, 895 aa, Staphylococcus aureus; identical to SEQ ID NO: 31307
  subsp. aureus CIG1835

SEQ ID NO: 37760 - protein, 2186 aa, Staphylococcus aureus; identical to SEQ ID NO: 31566
  subsp. aureus CIG1835

SEQ ID NO: 37761 - protein, 331 aa, Staphylococcus aureus; identical to SEQ ID NO: 31305
  subsp. aureus CIG1835

SEQ ID NO: 37762 - protein, 325 aa, Staphylococcus aureus; identical to SEQ ID NO: 30484
  subsp. aureus CIG1835

SEQ ID NO: 37763 - protein, 312 aa, Staphylococcus aureus; identical to SEQ ID NO: 30196
  subsp. aureus CIG1835

SEQ ID NO: 37764 - protein, 234 aa, Staphylococcus aureus; identical to SEQ ID NO: 36037
  subsp. aureus CIG1835

SEQ ID NO: 37765 - protein, 291 aa, Staphylococcus aureus; identical to SEQ ID NO: 30390
  subsp. aureus CIG1835

SEQ ID NO: 37766 - protein, 327 aa, Staphylococcus aureus; identical to SEQ ID NO: 30538
  subsp. aureus CIG1835

SEQ ID NO: 37767 - protein, 311 aa, Staphylococcus aureus; identical to SEQ ID NO: 30617
  subsp. aureus CIG1835

SEQ ID NO: 37768 - protein, 96 aa, Staphylococcus aureus; identical to SEQ ID NO: 31559
  subsp. aureus CIG1835

SEQ ID NO: 37769 - protein, 257 aa, Staphylococcus aureus; identical to SEQ ID NO: 30259
  subsp. aureus CIG1835

SEQ ID NO: 37770 - protein, 231 aa, Staphylococcus aureus
  subsp. aureus CIG1835
MFFFTFLIKNNLAYADVGVINLRNFYANYQPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYKSKFNSGFNKGKITFHLNNEPSFTYDLFYTGTGQAESFLKIYNDNKTIDAENFHLDVEISYEKTE

SEQ ID NO: 37771 - protein, 242 aa, Staphylococcus aureus; identical to SEQ ID NO: 31293
  subsp. aureus CIG1835

SEQ ID NO: 37772 - protein, 274 aa, Staphylococcus aureus; identical to SEQ ID NO: 30872
  subsp. aureus CIG1835

SEQ ID NO: 37773 - protein, 338 aa, Staphylococcus aureus; identical to SEQ ID NO: 31292
  subsp. aureus CIG1835

SEQ ID NO: 37774 - protein, 350 aa, Staphylococcus aureus; identical to SEQ ID NO: 31291
  subsp. aureus CIG1835

SEQ ID NO: 37775 - protein, 44 aa, Staphylococcus aureus; identical to SEQ ID NO: 30451
  subsp. aureus CIG1835

SEQ ID NO: 37776 - protein, 231 aa, Staphylococcus aureus; identical to SEQ ID NO: 31073
  subsp. aureus CIG1835

SEQ ID NO: 37777 - protein, 815 aa, Staphylococcus aureus; identical to SEQ ID NO: 31288
  subsp. aureus CIG1835

SEQ ID NO: 37778 - protein, 141 aa, Staphylococcus aureus; identical to SEQ ID NO: 30633
  subsp. aureus CIG1835

SEQ ID NO: 37779 - protein, 807 aa, Staphylococcus aureus; identical to SEQ ID NO: 30716
  subsp. aureus CIG2018

SEQ ID NO: 37780 - protein, 141 aa, Staphylococcus aureus; identical to SEQ ID NO: 30715
  subsp. aureus CIG2018

SEQ ID NO: 37781 - protein, 309 aa, Staphylococcus aureus; identical to SEQ ID NO: 30406
  subsp. aureus CIG2018

SEQ ID NO: 37782 - protein, 315 aa, Staphylococcus aureus; identical to SEQ ID NO: 30440
  subsp. aureus CIG2018

SEQ ID NO: 37783 - protein, 325 aa, Staphylococcus aureus; identical to SEQ ID NO: 30407
  subsp. aureus CIG2018

SEQ ID NO: 37784 - protein, 196 aa, Staphylococcus aureus; identical to SEQ ID NO: 30587
  subsp. aureus CIG2018

SEQ ID NO: 37785 - protein, 444 aa, Staphylococcus aureus; identical to SEQ ID NO: 32034
  subsp. aureus CIG2018

SEQ ID NO: 37786 - protein, 917 aa, Staphylococcus aureus; identical to SEQ ID NO: 34298
  subsp. aureus CIG2018

SEQ ID NO: 37787 - protein, 995 aa, Staphylococcus aureus; identical to SEQ ID NO: 31038
  subsp. aureus CIG2018

SEQ ID NO: 37788 - protein, 233 aa, Staphylococcus aureus; identical to SEQ ID NO: 30428
  subsp. aureus CIG2018

SEQ ID NO: 37789 - protein, 508 aa, Staphylococcus aureus; identical to SEQ ID NO: 34278
  subsp. aureus CIG2018

SEQ ID NO: 37790 - protein, 241 aa, Staphylococcus aureus; identical to SEQ ID NO: 30776
  subsp. aureus CIG2018

SEQ ID NO: 37791 - protein, 879 aa, Staphylococcus aureus
  subsp. aureus CIG2018
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSYSDSDSDSDSDSDSDSDSDSDSDSDSDSDSDSDSDSDSDSDSDSDSDSDSDSDSDSDSRVTPPNNEQKTPSNPKGEVNHSNKVSKQHKTDALPETGDKSENTNATLFGAMMALLGSLLLFRKRKQDHKEKA

SEQ ID NO: 37792 - protein, 1503 aa, Staphylococcus aureus; identical to SEQ ID NO: 33069
  subsp. aureus CIG2018

SEQ ID NO: 37793 - protein, 681 aa, Staphylococcus aureus; identical to SEQ ID NO: 32025
  subsp. aureus CIG2018

SEQ ID NO: 37794 - protein, 434 aa, Staphylococcus aureus [sequence omitted]

SEQ ID NO: 37795 - protein, 933 aa, Staphylococcus aureus; identical to SEQ ID NO: 30755
  subsp. aureus CIG2018

SEQ ID NO: 37796 - protein, 242 aa, Staphylococcus aureus; identical to SEQ ID NO: 30536
  subsp. aureus CIG2018

SEQ ID NO: 37797 - protein, 231 aa, Staphylococcus aureus; identical to SEQ ID NO: 36718
  subsp. aureus CIG2018

SEQ ID NO: 37798 - protein, 947 aa, Staphylococcus aureus; identical to SEQ ID NO: 30761
  subsp. aureus CIG2018

SEQ ID NO: 37799 - protein, 1375 aa, Staphylococcus aureus; identical to SEQ ID NO: 36730
  subsp. aureus CIG2018

SEQ ID NO: 37800 - protein, 1154 aa, Staphylococcus aureus; identical to SEQ ID NO: 31977
  subsp. aureus CIG2018

SEQ ID NO: 37801 - protein, 266 aa, Staphylococcus aureus; identical to SEQ ID NO: 30401
  subsp. aureus CIG2018

SEQ ID NO: 37802 - protein, 645 aa, Staphylococcus aureus; identical to SEQ ID NO: 30747
  subsp. aureus CIG2018

SEQ ID NO: 37803 - protein, 350 aa, Staphylococcus aureus; identical to SEQ ID NO: 30602
  subsp. aureus CIG2018

SEQ ID NO: 37804 - protein, 109 aa, Staphylococcus aureus; identical to SEQ ID NO: 30744
  subsp. aureus CIG2018

SEQ ID NO: 37805 - protein, 165 aa, Staphylococcus aureus; identical to SEQ ID NO: 30742
  subsp. aureus CIG2018

SEQ ID NO: 37806 - protein, 319 aa, Staphylococcus aureus; identical to SEQ ID NO: 30741
  subsp. aureus CIG2018

SEQ ID NO: 37807 - protein, 238 aa, Staphylococcus aureus; identical to SEQ ID NO: 30740
  subsp. aureus CIG2018

SEQ ID NO: 37808 - protein, 241 aa, Staphylococcus aureus; identical to SEQ ID NO: 30739
  subsp. aureus CIG2018

SEQ ID NO: 37809 - protein, 241 aa, Staphylococcus aureus; identical to SEQ ID NO: 30738
  subsp. aureus CIG2018

SEQ ID NO: 37810 - protein, 291 aa, Staphylococcus aureus; identical to SEQ ID NO: 34290
  subsp. aureus CIG2018

SEQ ID NO: 37811 - protein, 372 aa, Staphylococcus aureus; identical to SEQ ID NO: 31084
  subsp. aureus CIG2018

SEQ ID NO: 37812 - protein, 895 aa, Staphylococcus aureus; identical to SEQ ID NO: 30734
  subsp. aureus CIG2018

SEQ ID NO: 37813 - protein, 2186 aa, Staphylococcus aureus; identical to SEQ ID NO: 33090
  subsp. aureus CIG2018

SEQ ID NO: 37814 - protein, 250 aa, Staphylococcus aureus; identical to SEQ ID NO: 31910
  subsp. aureus CIG2018

SEQ ID NO: 37815 - protein, 690 aa, Staphylococcus aureus; identical to SEQ ID NO: 30419
  subsp. aureus CIG2018

SEQ ID NO: 37816 - protein, 203 aa, Staphylococcus aureus; identical to SEQ ID NO: 30770
  subsp. aureus CIG2018

SEQ ID NO: 37817 - protein, 226 aa, Staphylococcus aureus; identical to SEQ ID NO: 30769
  subsp. aureus CIG2018

SEQ ID NO: 37818 - protein, 231 aa, Staphylococcus aureus; identical to SEQ ID NO: 30768
  subsp. aureus CIG2018

SEQ ID NO: 37819 - protein, 67 aa, Staphylococcus aureus; identical to SEQ ID NO: 36707
  subsp. aureus CIG2018

SEQ ID NO: 37820 - protein, 234 aa, Staphylococcus aureus; identical to SEQ ID NO: 31052
  subsp. aureus CIG2018

SEQ ID NO: 37821 - protein, 231 aa, Staphylococcus aureus; identical to SEQ ID NO: 31761
  subsp. aureus CIG2018

SEQ ID NO: 37822 - protein, 231 aa, Staphylococcus aureus; identical to SEQ ID NO: 30560
  subsp. aureus CIG2018

SEQ ID NO: 37823 - protein, 232 aa, Staphylococcus aureus; identical to SEQ ID NO: 31054
  subsp. aureus CIG2018

SEQ ID NO: 37824 - protein, 232 aa, Staphylococcus aureus; identical to SEQ ID NO: 30765
  subsp. aureus CIG2018

SEQ ID NO: 37825 - protein, 227 aa, Staphylococcus aureus; identical to SEQ ID NO: 30585
  subsp. aureus CIG2018

SEQ ID NO: 37826 - protein, 225 aa, Staphylococcus aureus; identical to SEQ ID NO: 30763
  subsp. aureus CIG2018

SEQ ID NO: 37827 - protein, 274 aa, Staphylococcus aureus; identical to SEQ ID NO: 30872
  subsp. aureus CIG2018

SEQ ID NO: 37828 - protein, 338 aa, Staphylococcus aureus; identical to SEQ ID NO: 30699
  subsp. aureus CIG2018

SEQ ID NO: 37829 - protein, 196 aa, Staphylococcus aureus
  subsp. aureus CIG2018
MPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 37830 - protein, 131 aa, Staphylococcus aureus
  subsp. aureus CIG2018
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKIQIG

SEQ ID NO: 37831 - protein, 44 aa, Staphylococcus aureus; identical to SEQ ID NO: 30513
  subsp. aureus CIG2018

SEQ ID NO: 37832 - protein, 257 aa, Staphylococcus aureus; identical to SEQ ID NO: 30259
  subsp. aureus CIG2018

SEQ ID NO: 37833 - protein, 231 aa, Staphylococcus aureus; identical to SEQ ID NO: 31073
  subsp. aureus CIG2018

SEQ ID NO: 37834 - protein, 2478 aa, Staphylococcus aureus; identical to SEQ ID NO: 33089
  subsp. aureus CIG2018

SEQ ID NO: 37835 - protein, 311 aa, Staphylococcus aureus; identical to SEQ ID NO: 30617
  subsp. aureus CIG2018

SEQ ID NO: 37836 - protein, 327 aa, Staphylococcus aureus; identical to SEQ ID NO: 30538
  subsp. aureus CIG2018

SEQ ID NO: 37837 - protein, 331 aa, Staphylococcus aureus; identical to SEQ ID NO: 30732
  subsp. aureus CIG2018

SEQ ID NO: 37838 - protein, 468 aa, Staphylococcus aureus
  subsp. aureus CIG290
MAGVITLNDGEFRSIDKHQIAVADTNVQTPDYEKLRNTWLDVNYGYDKYDEKNDAMKKKFDATEKEAEKLLSSMKTESDRKYLWSGTENLETNSSHMTRTYRNIEKIAEAMKHKNTKLKTDENKKKVKDALEWLHKNAYGKEPDKKVADLKTNFSKSAPQKNTNLNWWDYEIGTPKSLTNTLILLNDQFSNEKKKKYTAPIKTFAPKSDEILSSVGKAEQAKGGNLVDIAKVKLLESIIEEDKDMTKNSIDSFNKVFTYVQSKATGKERNGFYKDGSYIDHQDVPYTGAYGVVLLEGISQMMPMIKETPFNDSNQNDTTLKSWIDDGFMPLIYKGEMMDLSRGRAISRENETSHTASATVMKSLLRLSDAMDESTKAKYKQIVKTSVKSDSTYGQNDTLSSYSDISKMKSLMEDSTISTNGLTQQLKIYNDMDRVTYHNKDLDFAFGLSMTSKNVARYESINNENLKG

SEQ ID NO: 37839 - protein, 315 aa, Staphylococcus aureus
  subsp. aureus CIG290
MSYLYNSDVKHYRDNFWATADMKRLAGTTTLDNEEPKENKNSDKTFVGGTKFDDQHASIGMDFENQDKTLTAKKSYFILNDKIVFLGTGIKSTDSSKNPVTTIENRKANGYTLYTDDKQTTTSNDQETNSVFLESTDTKKNIGYHFLNKSKINVKKESHTGKWSEINKSQKTEDKKDEYYEVTQKHSNSDNKYGYVLYPGLSKDVFKSKASQVTVVKQDDDFHVVKDNESVWAGVNYSDSAKTFEINGTKVEVKAKGMFILKKKDDKTYECSFYNPESTNTASDIEYKISMTGYSITNKNASTTNESGVRFELTK

SEQ ID NO: 37840 - protein, 141 aa, Staphylococcus aureus; identical to SEQ ID NO: 32806
  subsp. aureus CIG290

SEQ ID NO: 37841 - protein, 309 aa, Staphylococcus aureus; identical to SEQ ID NO: 33946
  subsp. aureus CIG290

SEQ ID NO: 37842 - protein, 315 aa, Staphylococcus aureus; identical to SEQ ID NO: 34526
  subsp. aureus CIG290

SEQ ID NO: 37843 - protein, 311 aa, Staphylococcus aureus
  subsp. aureus CIG290
MALLLLSNTANAEGKITPVSVKKVDDKVTLYKTTATADSDKFKISQILTFNFIKDKSYDKDTLVLKAAGNINSGYERPNPKDYDFSKIYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNYKTRTFKSTYEIDWENHKVKLLDTKETEINK

SEQ ID NO: 37844 - protein, 1197 aa, Staphylococcus aureus
  subsp. aureus CIG290
MTQLLENSNKESTEEKTDLQTNENETLQGGVSNNTLNREVEKENVNGIQEKPNAQKEEKTLSDSQLTRSSQQDNSTTTASPQTNDHQLPIKHDTSYEKSTSNSTLNEQPMEPTPFPNNTVKTEEVGATQNAATVPLQLQTVKGTKQLRAVNTAAVTPAVSGGTNVNDKVTASNMDISESYIEPNNSGSFYLNSRFTVNGTVKEGDYFTVKMPNAVNTYGDTRYYSDFREELKNSNGDVIALGEYDVASHTLTYKFTSTVNNLQNVTGSFNLTQFMDRQVAKTSDTYPLKYEIAGESFNTQIKVHYGQYHHIGDSNLKSMITMEDSKTGEYEQYIYVNPLKKDAYGTVVRVKGFSNNLSDSNGQVNPDTTQIKILKVDEKQDLNDSFGVDDSQYEDVTNQFKTVYDENNLADIHFGDLHGARYIIKVTSKEKEDSSADLKLSSSMYTKNRYGQYDRITWDNHIVKSSSSGNADGTEVSYQLGDKVWNDANKNGIQDAGEFGIPGVKVILKDKDGNFLEKTETNANGKYVFDNLSNGIYTVDFEAPEGYTASPQNQGNDALDSDGPTSAHAIISDGNNLTIDQGFYLTEPPVPTTHNIGDKVWEDLNKDGIQDDNEPGISNVKVTLTDSDGNVVDTRKTDDKGNYLFEDVKAGDYIVTFETPEGFTPTQTGQGTIDNDSNGTSTKVTVGDSDDLSLDSGFYKTPKYNLGNYVWEDTNKDGKQDSTEKGISGVTVTLKNENGEVLQTTKTDKDGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDKDHNDKTDKSNNKELPDTGNDVPNNDTLFGSLFATLGGLFLIGRRRKNKNNNAEK

SEQ ID NO: 37845 - protein, 731 aa, Staphylococcus aureus
  subsp. aureus CIG290
MRDKKGPVNKRVDFLSNKLNKYSIRKFTVGTASILIGSLMYLGTQQEAEAAENNIENPTTLKDNVQSKEVKIEEVTNKDTAPQGIEVKSEVTSNKDTIEHGPSVKAEDISKKEDTPKEVANVAEVQPKSSVTHNAETPKVRKARSVDEGSFDITKDSKNVVESTPITIQGKEHFEGYGSVDIQSNPEDLKVSEVTRFNNKSIGRNELTGALQLKNKVSFKNDFEFNIRIANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSVDTTDGKFHGQLLNNLKLAYNEKSGIMRAEYAGKVWEANISDLGLDKSEVYNFLITSSQRQGTSQGVYANGWMRTDLNNSTFKLTPNLVNKPETKTVEIPFETKREFNPKLQPGEERVKQEGQPGSKTITTPITVNSLTGEKVGEGQPTEEITKQPVDKIVEFGGEKIPQGHKDIFDPNLPTDQTEKVPGKPGVKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNDPVHSMDKNDKVKKSKIAKESVANQEKKRAELPKTGVESTQKGLIFSSIIGIAGLILLARRRKN

SEQ ID NO: 37846 - protein, 936 aa, Staphylococcus aureus
  subsp. aureus CIG290
MIVVGMGQEKEAAASEQNNTTVEESGSSATESKASETQTTTNNVNTIDETQSYSATSTEQPSQSTQVTTEEAPTTVQAPKVETSRVDLPSENVADKEITGTQVDTAQPSNVPEIKPRMKRSADVTAVAEKEVVEEAKETGSDVTNKVTVENGSEIVGHKQDTNVVNPHNAERVTLKYKWKFGEGIKEGDYFDFTLSDNVETHGISTLRKVPEIKSTDGQVMATGEVIEERKIRYTFKEYVKDKKDLTAELSLNLFIDPTTVTKKGKQKFEVSLGQNKISQEFDIQYLDGVKNPMGVTVNGRIHTLNKEEGKFSHFAYVKPNNQSLSSVTVTGQVTSGYKQDGGNPTVRVYKYTGKEGLAESVFADLSKNDQYEDITSQLSISYNSGGYTINFESLDNNKDYVIKYEGAYDAKSESLQLQTHLSAYNDYYYYPYYPVQLTWKNGVAFYSNNAQGDGKDKPNDPIIEKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPSYQFGGHNGIDFVEDTLPQVSGHNEGQQTIEEDTTPPIVPPTPPTPEVPSEPEIPTPEVPSEPETPTPPTPTPPTPEVPSEPETPTPPTPEVPAEPGKPVPPAKEEPKKPSKPVEQGKVVTPVIEINEKVKPVAPTKQKQSKKSELPETGGEESTNKGMLFGGLFSILGLTLLRRNKKNNKA

SEQ ID NO: 37847 - protein, 1047 aa, Staphylococcus aureus
  subsp. aureus CIG290
MIVVGMGQDKEAAASEQKTTTVEENGNSATENKTSETQTTATNVNHIEETQSYNATVTEQPSNATQVTTEEAPKAAVQAPQTAQPANVETVKEEVVKEEAKPQVKETTQSQDNSGDQRQVDLTPKKVTQNQVAETQVVVAQPRTASESKPRVTRSADVVEAKEASNASEIKGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQNNGQQTITSKLNGKETSGTMQITYKDGVKNQYTNVNGSIETFDKEKNKFTHVAYIKPINGNNSDSVTVTGVLTQGSNEYGTQPNVKIYEYVGTEKGLPQSVYANTADSTQLKDVTNQMSDKLKVQNNGSYSLNFDKLDKTYVIHYTGDYLNGTSEVNFRTQLTGYPENRYKTYYYYNNGYTLTWDNGLVLYSNKADGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGSQVNTESNLVEFDEDSTKGIVTGAVSDHTTVEDTKEYTTESNLIELVDELPEEHGQAQGLIEEITENNQHISHSGLGTENGHGNYGVIEEIEENSHVDIKSELGYEGGQNIGNQSFEEDTEEDKPKYEQGGNIVDIDFDSVPQIQGQNKGDQSFEEDTEKDKPKYEQGGNIVDIDFDSVPQIQGQNIGNQSFEEDTEKDKPKYEHGGNIIDIDFDSVPHIHGFNKHTEIIEEDTNKDKPSYQFGGHNGIDFVEDTLPKVSGQNEGQQTIEEDTTPPTPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVVPTKQKQSKKSELPETGGEESTNKGMLFGGLFSILGLTLLRRNKKNNKA

SEQ ID NO: 37848 - protein, 233 aa, Staphylococcus aureus; identical to SEQ ID NO: 34563
  subsp. aureus CIG290

SEQ ID NO: 37849 - protein, 943 aa, Staphylococcus aureus
  subsp. aureus CIG290
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRAVRSLAVTEPVVNAADAKGTNVNGQVTASDFKLEKTTFDPNQSGNTFMAANFKVAGKVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPKPDPEPSPDPEPEPTPDPEPSPDPEPEPTPDPEPTPDPEPSPDPEPSPDPDPEPSPDPDPDSDSDSDSDSDSESDSDSDSDLGSDSDSDSESDSDSDSDSDSDSDSDSDSDSDSDSDSDSDSDSDSDSDSDSDSDSDSDSDSDSDSDSDSDSDSDSDSDSDSDSDSDSESDSDSDSDSDSESDSDSESDSDSDSDSDSDSDSDSDSDSDSDSDSDSDSDSDSESDSDSDSDSDSDSDSDSDSDSDSDSDSDSDSDSDSESDSDSDSDSDSDSDSDSDSDSDSDSDSDSDSDPDPDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 37850 - protein, 2223 aa, Staphylococcus aureus
  subsp. aureus CIG290
MTGYGLKTTAVIGGAFTVNMLHDQQAFAASDAPLTSELNTQSETVGNQNSTTIEASTSTADSTSVTKNSSSVQTSNSDTVSSEKSESITSTTNSTSNQQEKLTSTSESTSSKNTTSSSDTKSVASTSSTEQPINTSTNQSTASNNTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSTPNASAKAKADPSSVAGGGAFGAFVTTDSYGVASTYTSSSAADNAAKLNVQPTNNAFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSVAGSQSVSTSTSDSMSTSEIVSDSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMSLSMSQSISGSTSTSTSTSLSDSTSTSLSLSASMNQSGVDSNSASQSASTSTSTSTSESDSQSTSSYTSQSTSQSESTSTSTSLSDSTSMSKSTSQSGSTSTSASLSGSESESDSQSVSTSASESTSESASTSLSDSTSTSNSTSESTSNAISTSASASESDSSSTSLSDSTSASMQSSESDSQSTSTSLSNSQSTSTSIRMSTIVSESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSMSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSVSTSDSSSISGSNSTSTSLSTSDSMSGSVSVSTSTSLSDSISGSISVSDSSSTSTSESLSDSMAQSQSTSTSASGSLSTSISTSMSMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSASMSQDKSDSTSISNSESVSTSTSTSLSTSDSTSTSESLSTSMSGSQSISDSTSTSMSNSTSMSNSTSTSMSGSTSTSESNSMHPSDSMSMHHTHSTSTSISTSEATTSTSESQSTLSATSEATKHNGTRAQSEERLPDTGESIKQNGLLGGIMTLLVGLGLMKRKKKKDENDQDDSQA

SEQ ID NO: 37851 - protein, 681 aa, Staphylococcus aureus; identical to SEQ ID NO: 34532
  subsp. aureus CIG290

SEQ ID NO: 37852 - protein, 797 aa, Staphylococcus aureus
  subsp. aureus CIG290
MLLNIITPLFNKNDALAARDISSTNVTDLTVSPSKIEDGGKTTVKMTFDDKNGKIQNGDTIKVAWPTSGTVKIEGYSKTVPLTVKGEQVGLAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGQSAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKAIEKTKDVSAQKVWEGTQKVKPTIYFKLYKQDDNQNTTPVDKAEIKKLEDGTTKVTWSNLPENDKNGKTIKYLVKEVNAQGEDATPEGYTKKENGLVVTNTEKPIEKTSISGEKVWDDKDNQDGKRPEKISVNLLANGEKVKTLDVTSETNWKYEFKDLPKYDEGKKIEYTVTEDHVKDYTTDINGTTITNKYTPGETSATVTKNWDDNNNQDGKRPTDIKVELYQDGKATGKTATLNESNNWTHTWTGLDEKVKGQQVKYTVEELTKVKGYTAHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 37853 - protein, 484 aa, Staphylococcus aureus; identical to SEQ ID NO: 34524
  subsp. aureus CIG290

SEQ ID NO: 37854 - protein, 241 aa, Staphylococcus aureus; identical to SEQ ID NO: 32842
  subsp. aureus CIG290

SEQ ID NO: 37855 - protein, 690 aa, Staphylococcus aureus; identical to SEQ ID NO: 34553
  subsp. aureus CIG290

SEQ ID NO: 37856 - protein, 59 aa, Staphylococcus aureus
  subsp. aureus CIG290
MGEHLSKGDIVINTKDGGKYTLESHKELQKNRENVKINTADVKNVTFELVKSVNDIEQV

SEQ ID NO: 37857 - protein, 226 aa, Staphylococcus aureus; identical to SEQ ID NO: 32850
  subsp. aureus CIG290

SEQ ID NO: 37858 - protein, 233 aa, Staphylococcus aureus; identical to SEQ ID NO: 32849
  subsp. aureus CIG290

SEQ ID NO: 37859 - protein, 343 aa, Staphylococcus aureus; identical to SEQ ID NO: 32848
  subsp. aureus CIG290

SEQ ID NO: 37860 - protein, 282 aa, Staphylococcus aureus; identical to SEQ ID NO: 32847
  subsp. aureus CIG290

SEQ ID NO: 37861 - protein, 234 aa, Staphylococcus aureus; identical to SEQ ID NO: 32846
  subsp. aureus CIG290

SEQ ID NO: 37862 - protein, 231 aa, Staphylococcus aureus; identical to SEQ ID NO: 33938
  subsp. aureus CIG290

SEQ ID NO: 37863 - protein, 232 aa, Staphylococcus aureus; identical to SEQ ID NO: 33937
  subsp. aureus CIG290

SEQ ID NO: 37864 - protein, 227 aa, Staphylococcus aureus; identical to SEQ ID NO: 32844
  subsp. aureus CIG290

SEQ ID NO: 37865 - protein, 231 aa, Staphylococcus aureus; identical to SEQ ID NO: 32843
  subsp. aureus CIG290

SEQ ID NO: 37866 - protein, 1108 aa, Staphylococcus aureus
  subsp. aureus CIG290
MIPNRLNKFSIRKYSVGTASILVGTTLIFGLSGHEAKAAEHTNGELNQSKNETTVPTENKTTEKVDSRQQNNIEQSTTSNQPKVNESDNTSVKETTEEPQNTTSTQPTKQNNDATANKDNLEAQNISTQAKDVSATPKTTTIKPRTLNRLAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNISGSFEQVAFAKRENAITDKTAYKMEVTLGNDAYSEEIIVDYGNKKAQPLITSTNYINNEDLSRNMTAYVNQPKNTYTKETFVSTLTGYKFNPNAKNFKIYEVTDQNQFVDSFTPDTSKLTDVTDQFDITYSNDNKTATVDLMKGQTSSNKQYIIQQVAYPENTSTDNGKIDYTLETDKTKYSWSNSYSNVNGSSTANGDQKKYNLGDYVWEDTNKDGKQDADEKGIKGVYVILKDSNGKELDRTTTDENGKYQFTGLSNGTYSVEFSTPDGYTPTTANAGTDDAVDSDGLTTTGVIKDEDNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTDDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHKKAKALPETGSENNGSNNATLFGGLFAALGSLLLFGRRKKQNK

SEQ ID NO: 37867 - protein, 1053 aa, Staphylococcus aureus
  subsp. aureus CIG290
MISNRLNKFSIRKYTVGTASILVGTTLIFGLGNQEAKAAENTSTENAKQDDATTSDNKEVVSETENNSTTENNLTNPIKKETNTDSQQEAKEAPTTSSTQQQQNNATTSTETKPQNIEKENVQPSTDKTATEDTSVILEEKKAPNNTNNDVTTKPSTSEIQTTPTTPQESTKIENSQPQATPSKVDNKVTDATNPKEPVNVSKEELKNNPEKLKELVRNDSNTDRSTKPVAIAPTSVAPKRVNAKMRFAVAQPAAVASNNVNDLIKVTKQTIKVGDGKDDVVAAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNPNQQLPQSNRIYDFSQYEDVTSQFDNKKTFGNNVATLDFGNIDSAYIIKVVSKYTPTSDGELDIAQGTSMRTTDNYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDTTEKGIKDVTVTLQNEKGEVIGTTKTDENGKYRFDNLDSGKYKVIFEKPAGLTQTGTNTTEDDKDADGGEVDVTITDHDDFTIDNGYFEEDTSDSDSDSDSDSDSDSDSDSDSDSDSDSDSDSDSDSDSDSDSDSDSDSDSDSDSDSDSDSDSDSDSESDSDSDTGKHTPVKPMSATKDHHNKAKALPETGSENNGSNNATLFGGLFAALGSLLLFGRRKKQNK

SEQ ID NO: 37868 - protein, 434 aa, Staphylococcus aureus [sequence omitted]

SEQ ID NO: 37869 - protein, 999 aa, Staphylococcus aureus
  subsp. aureus CIG290
MNMKKQEKHAIRKKSIGVASVLVGTLIGFGLLSSKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVVNQAVNTSAPRMRAFSLAAVAADAPAAGTDITNQLTNVTVGIDSGDTVYPHQAGYVKLNYGFSVPNSAVQGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQIDKTNNTYRQTIYVNPSGDNVIAPVLTGNLKPNTESNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSASDSDSTSDSDSASDSDSASDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSASDSDSDSDSDSDSDSDSDSDSDLASDSDSASDSDSASDSDSDSDSDSDSDSDSDSDSDSNSDSDSDSDSDSDSDSDSDSDSDSDSDSDSDSDSDSDSDSDSDSDSDSASDSDSGSDSDSSSDSDSDSDSDSASDSDSDSTSDTGSDNDSDSSSDSDSDSDSDSDSDSDSDSDNDSDSASDSDSDSDSESGSNNNVVPPNSPKNGTNASNKNEAKDSKEPLPDTGSEDEANTSLIWGFLASLGSLLLFRRKKENKDKN

SEQ ID NO: 37870 - protein, 641 aa, Staphylococcus aureus; identical to SEQ ID NO: 34522
  subsp. aureus CIG290

SEQ ID NO: 37871 - protein, 350 aa, Staphylococcus aureus
  subsp. aureus CIG290
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQTKVEKVKPAVTAPSKAENTQTTKVVSTEATKDQSQTHSARTVKTTQTAQEQNKVQTPVKDVATAKSESNNQAVSDNKSQQTNKVTKQNETPKQASKAKELPKTGLTSVDNFISTVAFATLALLGSLSLLLFKRKESK

SEQ ID NO: 37872 - protein, 105 aa, Staphylococcus aureus; identical to SEQ ID NO: 31317
  subsp. aureus CIG290

SEQ ID NO: 37873 - protein, 165 aa, Staphylococcus aureus; identical to SEQ ID NO: 32831
  subsp. aureus CIG290

SEQ ID NO: 37874 - protein, 319 aa, Staphylococcus aureus; identical to SEQ ID NO: 32830
  subsp. aureus CIG290

SEQ ID NO: 37875 - protein, 238 aa, Staphylococcus aureus; identical to SEQ ID NO: 34517
  subsp. aureus CIG290

SEQ ID NO: 37876 - protein, 210 aa, Staphylococcus aureus
  subsp. aureus CIG290
MSSEAKAYNISENETNVNELTKYYTQRHLTFSNKWLWQKDNGTIHATLLQLSWFSHIQVFGPESWGNINQLRNKYVDIFALKDYETWHTYMLAQETFTGGVTPAAKPSDKHYKLNLTYKDKSGTFIGEHPFYTGNKPVLTLKEVDFRIRQTLIKNKKLYHGNYNKGHIKITGGSNNYTIDLSKRLKSTDANRYVKNPQTAHTEILLEKSS

SEQ ID NO: 37877 - protein, 62 aa, Staphylococcus aureus; identical to SEQ ID NO: 31886
  subsp. aureus CIG290

SEQ ID NO: 37878 - protein, 291 aa, Staphylococcus aureus; identical to SEQ ID NO: 30390
  subsp. aureus CIG290

SEQ ID NO: 37879 - protein, 871 aa, Staphylococcus aureus; identical to SEQ ID NO: 34555
  subsp. aureus CIG290

SEQ ID NO: 37880 - protein, 2182 aa, Staphylococcus aureus
  subsp. aureus CIG290
MNLLKKNKYSIRKYKVGIFSTLIGTVLLLSNPNGAQALTTDHNVQGGSNQALPGNSQNTNADTNRNIVNGSQNTPNADATDNTSTNQALTNHQNVGVANQVAPTPVQPNSLSELNNNHSDAHATVTETASNTNHHLATNNSTLNVPNNINDNDSERHLTLKEIQEDVRHSSDKPELVAIAEEASNRPKKRSRRAAPADPNATPADPAAGNGGAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIKGNDTNDHGDFNGIEKTLTVNPNSELIFEFNTMTTKNYQGMTNLVIKNADNDAVLGEKVVAYGPIWRLFKVPENVSHLKIQFSPKNDAITDVRGIYQLRDGYKYYDFVDSIGLHSGSHLYVERRIMEPTATNNKEFTVTTSLKNNGNFGASFNTDDFVYKIQLPEGVEYVNNSLTKDFPSGNSGVDMNDMNVTYDATNRIITIKSTGGGSGNSPARLMPDKILDLKYKLRVNNVPTPRTVTFNDTLTYKTFSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINNTPDATQDEIQDALNQLTTDETDAIDNVTNATTNADVETAKNNGINTIGAVVPQVTHKQAARDAINQATATKRQQINSNREATQEEKNAALNELTQATNHALEQINQATTNDDVDTAKGDGLNVINPIAPVTVVKQAARDAVSHDAQQHIAEINANPDATQEERQAAIEKVNAAVAAANTNILNANSNADVEQVKTNAIQGIQAIEPATKVKTDAKNAIDQSAETQHNAIFNNNDATLEEQQAAQQLLDQAVATAKQNINAADTNQEVAQAKDQGTQNILAIQPATQVKTDARNTVNEKAREAISNINATPGATREEKQEAIDRVNTLKNRALTDIGVTSTTAMVNSIRDDAVNQIGTVQPHVTKKQSASGVLTDLATAKKQEINQNTNATDEEKQVALNQVDQDLATAINNINQADTNAEVDQALQAGKQAMNAIQPNIVKKPAVLAQINQHYNAKLAEINATPDATDDEKNAAINILNQDRQQAIESIKLANTNAEVDQAATVAENNIDTVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATDGITAIKMIQPETKVKPAAREKINQKANELRAQINQDKEATAEERQAALDKINDLVAKAMTNITNDRTNQQVNDSTNQALDDIALVTPDHIVRATARDAVKQQYEVKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQNIDNTTQDAAVNDVRNQTIKAIEQIKPKVRRKRAALDNIDESNNNQLAAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKTTALQQIQNIATHKINLIKSNNEATDEEQNAAIAQVEQALIKAKQHIASAVTNADVAYLLHDGKNEIREIEPVINRKASAREQLTTLLNDKKQAIEANVQATVEERNSVLAQLQNIYDAAIGQLDHDRSNAQVDKTASFNLQTIQGLDVHPVKKPEAEKTINQDIARVTHLVQNYRKVSDRNKADALKAITALKLQMDEELKTARTNADVDAVLKRFNVALGDIEAVITEKEHSLMRIENIAQQTYAKFKAIATPEQLAKVKALIDQYVADGNRMIDEDATLNDIKQHTQFIIDEILAIKLPAEVIKASPKVGQPAPKVCTPIKKEDKQEVRKVEKELPNTGSEEMDLPLKELALITGAALLARRRTKNEKES

SEQ ID NO: 37881 - protein, 331 aa, Staphylococcus aureus; identical to SEQ ID NO: 34565
  subsp. aureus CIG290

SEQ ID NO: 37882 - protein, 808 aa, Staphylococcus aureus; identical to SEQ ID NO: 34528
  subsp. aureus CIG290

SEQ ID NO: 37883 - protein, 258 aa, Staphylococcus aureus; identical to SEQ ID NO: 30410
  subsp. aureus CIG290

SEQ ID NO: 37884 - protein, 165 aa, Staphylococcus aureus; identical to SEQ ID NO: 30805
  subsp. aureus CIG290

SEQ ID NO: 37885 - protein, 238 aa, Staphylococcus aureus; identical to SEQ ID NO: 33836
  subsp. aureus CIG290

SEQ ID NO: 37886 - protein, 242 aa, Staphylococcus aureus; identical to SEQ ID NO: 32821
  subsp. aureus CIG290

SEQ ID NO: 37887 - protein, 181 aa, Staphylococcus aureus
  subsp. aureus CIG290
MDNSTITAEFKNVDDVKKFKNHAVDVYGLSYSGYCLKNKYIYGGVTLAGDYLEKSRCIPINLWVNGEHQTISTDKVSTNKKLVTAQEIDTKLRRYLQEEYNIYGFNDTNKGRNYGNKSKFSSGFNAGKILFHLNDGSSFSYDLFDTGTGQAESFLKIYNDNKTVETEKFHLDVEISYKDES

SEQ ID NO: 37888 - protein, 254 aa, Staphylococcus aureus
  subsp. aureus CIG290
MLNVLLLILNLIAICSVNNAYANEEDPKIESLCKKSSVDPIALHNINDDYINNRFTTVKSIVSTTEKFLDFDLLFKSINWLDGISAEFKDLKVEFSSSAISKEFLGKTVDIYGVYYKAHCHGEHQVDTACTYGGVTPHENNKLSEPKNIGVAVYKDNVNVNTFIVTTDKKKVTAQELDIKVRTKLNNAYKLYDRMTSDVQKGYIKFHSHLEHKESFYYDLFYIKGNLPDQYLQIYNDNKTIDSSDYHIDVYLFT

SEQ ID NO: 37889 - protein, 274 aa, Staphylococcus aureus; identical to SEQ ID NO: 33993
  subsp. aureus CIG290

SEQ ID NO: 37890 - protein, 339 aa, Staphylococcus aureus; identical to SEQ ID NO: 32812
  subsp. aureus CIG290

SEQ ID NO: 37891 - protein, 351 aa, Staphylococcus aureus; identical to SEQ ID NO: 32811
  subsp. aureus CIG290

SEQ ID NO: 37892 - protein, 44 aa, Staphylococcus aureus; identical to SEQ ID NO: 30513
  subsp. aureus CIG290

SEQ ID NO: 37893 - protein, 231 aa, Staphylococcus aureus; identical to SEQ ID NO: 33931
  subsp. aureus CIG290

SEQ ID NO: 37894 - protein, 2450 aa, Staphylococcus aureus
  subsp. aureus CIG290
MNLFRQQKFSIRKFNVGIFSALIATVTFISINPTTASAAEQNQPAQNQPAQPADASAQPNANAGAQANPTAQPAAPANQGGQADPAANQGGQATPAAGTTQPAGGAAQPAAGTTQPAVGTTQPAGQGNQADPNNAVQAQPGNQAAPANQAGQGNNQATPNNAAPANQTQPANAQPQDPNANNTGEGSINTTLTFDDPAISTNDNRQDPTVTVTDHVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDDSHFTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINKAKVSGVKAIEATTTAQELERVKNEEIFKIENITDSTQTKMDAYKEVKQAATARKAQTATVSNATDEEVAEANAAVDAAQTEGLHDIQVVKSQQEVADTKAKVLDKINAIQTQARVKPAADREVDNAYNTRKQEIQNSNASTTEEKEAAYTQLDAKKQEARTNLDAANTNSAVTTAKDNGIAAINQVQAATTKKSDAKAEIAQKASERKTAIEAMNDSTTEEQQAAKDKVDQAVVTANADIDNAAANTDVDNAKATNEATIAAITPDANVKSTAKQAIADKVQAQETAIDANNGATTEEKNAAKQQVQTEKTTADAAIDGAHSNAEVEAAKNAEIAKIEAIQPATTTKDDAKQAIATKANERKAAIAQTQDITAEEIEAANANVDNAVTEANSHIEAANSQNEVDQAKTTGESSIDQVTPTVNKKATARNEITTALNNKLQEIQATPDATDEEKQEADLEANTENAKANHAITAATTNAEVDDAKANAEVAINAVTPKVMKKQAAKDEIDQLQAVQTAIINNDQNATNEEKEAAIQQLATAVTDAKNNITAATDNNGVDTAKDAGKNSIQSTQPATAVKSNAKNDVDQAVTTQNQAIDNTTDATTEEKNAAKDLVLKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLNEMQNKITEILNDNTTTNEEKGKDIGPVRAAYEEGLNNINTSTTTGDVTTAKDAAVQKVQQLHANPVKKPSGKTALDQAAADKKTQIEQTPNASQQEINDAKQEVDTVLNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTIATQDEKQQAIKQVDQNVQTALESINNGVDNGDVDDALTQGKATIDAVQVDASVKPKANQAIEAKAEETKESIDQSDQLTAEEKTEALATIKQITDQAKQGITDAATTAEVEKAKAQGLEAFDNIQIDSTEKQKAIEELETALDQIEAGVNVDSDATTEEKEAFTNALEDILSKATEDISDQTTNAEIATVKNSALEQLKAQRINPEVKKNALEAIREVVNKQIEIIKNADASAKEIARTDLGRYFDRFADKLDKTQTNAEVDELQNVTIPAIEAIVPQKDPNANDTNSGSDNNDATANSNTNATPENTGQPNVTESTDNANADTSSTTTNNHNDSATGETTGTSTNNSSTDDANDKPTANNNSSVDASTDNSATGNGTTDKPAVELTNNGTTDKPATTESTETTSTADRKDNASVNASNQNAEVNNSAESQPINGKVAQPKSENKAKVEKDGRDSTNQSMVESTTETLPSADITEPNVPSNTSKDKEESTSNQTDAGQLKSETNVASNEADKSPSKADTAVSNKPSTSASSETKDKATSTEDSQKADMATADTKDNQAAIGATADVNNKATQNDGANASPVTVSNGSHSMHHDMLKVTNTDKHEAKATSAQQGKENKAKQQAKTLPDTGMSHNDDLPYAELALGAGMAFLIRRFTKKDQQTEE

SEQ ID NO: 37895 - protein, 807 aa, Staphylococcus aureus
  subsp. aureus CIG547
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSTSDIESKISMTGYSITNKNTSTSNESGVHFELTK

SEQ ID NO: 37896 - protein, 141 aa, Staphylococcus aureus; identical to SEQ ID NO: 30715
  subsp. aureus CIG547

SEQ ID NO: 37897 - protein, 309 aa, Staphylococcus aureus; identical to SEQ ID NO: 30406
  subsp. aureus CIG547

SEQ ID NO: 37898 - protein, 315 aa, Staphylococcus aureus; identical to SEQ ID NO: 30440
  subsp. aureus CIG547

SEQ ID NO: 37899 - protein, 325 aa, Staphylococcus aureus
  subsp. aureus CIG547
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLGGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 37900 - protein, 859 aa, Staphylococcus aureus
  subsp. aureus CIG547
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 37901 - protein, 917 aa, Staphylococcus aureus; identical to SEQ ID NO: 31037
  subsp. aureus CIG547

SEQ ID NO: 37902 - protein, 995 aa, Staphylococcus aureus; identical to SEQ ID NO: 31038
  subsp. aureus CIG547

SEQ ID NO: 37903 - protein, 233 aa, Staphylococcus aureus; identical to SEQ ID NO: 30428
  subsp. aureus CIG547

SEQ ID NO: 37904 - protein, 891 aa, Staphylococcus aureus
  subsp. aureus CIG547
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKTPSNPKGEVNHSNKVSKQHKTDALPETGDKSENTNATLFGAMMALLGSLLLFRKRKQDHKEKA

SEQ ID NO: 37905 - protein, 1503 aa, Staphylococcus aureus
  subsp. aureus CIG547
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESNSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 37906 - protein, 681 aa, Staphylococcus aureus; identical to SEQ ID NO: 32025
  subsp. aureus CIG547

SEQ ID NO: 37907 - protein, 447 aa, Staphylococcus aureus
  subsp. aureus CIG547
MKKKNIYSIRKLGVGIASVTLGTLLISGGVTPAANAAQHDEAQQNAFYQVLNMPNLNADQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNKKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 37908 - protein, 241 aa, Staphylococcus aureus; identical to SEQ ID NO: 30776
  subsp. aureus CIG547

SEQ ID NO: 37909 - protein, 644 aa, Staphylococcus aureus; identical to SEQ ID NO: 31782
  subsp. aureus CIG547

SEQ ID NO: 37910 - protein, 203 aa, Staphylococcus aureus; identical to SEQ ID NO: 30770
  subsp. aureus CIG547

SEQ ID NO: 37911 - protein, 226 aa, Staphylococcus aureus; identical to SEQ ID NO: 30769
  subsp. aureus CIG547

SEQ ID NO: 37912 - protein, 231 aa, Staphylococcus aureus; identical to SEQ ID NO: 30768
  subsp. aureus CIG547

SEQ ID NO: 37913 - protein, 356 aa, Staphylococcus aureus
  subsp. aureus CIG547
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 37914 - protein, 234 aa, Staphylococcus aureus; identical to SEQ ID NO: 31052
  subsp. aureus CIG547

SEQ ID NO: 37915 - protein, 231 aa, Staphylococcus aureus; identical to SEQ ID NO: 31761
  subsp. aureus CIG547

SEQ ID NO: 37916 - protein, 231 aa, Staphylococcus aureus; identical to SEQ ID NO: 30560
  subsp. aureus CIG547

SEQ ID NO: 37917 - protein, 232 aa, Staphylococcus aureus; identical to SEQ ID NO: 31054
  subsp. aureus CIG547

SEQ ID NO: 37918 - protein, 232 aa, Staphylococcus aureus; identical to SEQ ID NO: 30765
  subsp. aureus CIG547

SEQ ID NO: 37919 - protein, 227 aa, Staphylococcus aureus; identical to SEQ ID NO: 30585
  subsp. aureus CIG547

SEQ ID NO: 37920 - protein, 225 aa, Staphylococcus aureus; identical to SEQ ID NO: 30763
  subsp. aureus CIG547

SEQ ID NO: 37921 - protein, 372 aa, Staphylococcus aureus; identical to SEQ ID NO: 31084
  subsp. aureus CIG547

SEQ ID NO: 37922 - protein, 947 aa, Staphylococcus aureus; identical to SEQ ID NO: 30761
  subsp. aureus CIG547

SEQ ID NO: 37923 - protein, 1369 aa, Staphylococcus aureus
  subsp. aureus CIG547
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 37924 - protein, 1154 aa, Staphylococcus aureus; identical to SEQ ID NO: 31977
  subsp. aureus CIG547

SEQ ID NO: 37925 - protein, 434 aa, Staphylococcus aureus [sequence omitted]

SEQ ID NO: 37926 - protein, 933 aa, Staphylococcus aureus; identical to SEQ ID NO: 30755
  subsp. aureus CIG547

SEQ ID NO: 37927 - protein, 242 aa, Staphylococcus aureus; identical to SEQ ID NO: 30536
  subsp. aureus CIG547

SEQ ID NO: 37928 - protein, 231 aa, Staphylococcus aureus; identical to SEQ ID NO: 36718
  subsp. aureus CIG547

SEQ ID NO: 37929 - protein, 266 aa, Staphylococcus aureus; identical to SEQ ID NO: 30401
  subsp. aureus CIG547

SEQ ID NO: 37930 - protein, 645 aa, Staphylococcus aureus; identical to SEQ ID NO: 30747
  subsp. aureus CIG547

SEQ ID NO: 37931 - protein, 350 aa, Staphylococcus aureus; identical to SEQ ID NO: 30602
  subsp. aureus CIG547

SEQ ID NO: 37932 - protein, 109 aa, Staphylococcus aureus; identical to SEQ ID NO: 30744
  subsp. aureus CIG547

SEQ ID NO: 37933 - protein, 165 aa, Staphylococcus aureus; identical to SEQ ID NO: 30742
  subsp. aureus CIG547

SEQ ID NO: 37934 - protein, 319 aa, Staphylococcus aureus; identical to SEQ ID NO: 30741
  subsp. aureus CIG547

SEQ ID NO: 37935 - protein, 238 aa, Staphylococcus aureus
  subsp. aureus CIG547
MSKNITKNIILTTTLLLLGTVLPQNQKPVFSFYSEAKAYSIGQDETNINELIKYYTQTHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 37936 - protein, 241 aa, Staphylococcus aureus; identical to SEQ ID NO: 30739
  subsp. aureus CIG547

SEQ ID NO: 37937 - protein, 241 aa, Staphylococcus aureus; identical to SEQ ID NO: 30738
  subsp. aureus CIG547

SEQ ID NO: 37938 - protein, 250 aa, Staphylococcus aureus; identical to SEQ ID NO: 31910
  subsp. aureus CIG547

SEQ ID NO: 37939 - protein, 291 aa, Staphylococcus aureus; identical to SEQ ID NO: 30390
  subsp. aureus CIG547

SEQ ID NO: 37940 - protein, 742 aa, Staphylococcus aureus
  subsp. aureus CIG547
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKSNT

SEQ ID NO: 37941 - protein, 331 aa, Staphylococcus aureus; identical to SEQ ID NO: 30732
  subsp. aureus CIG547

SEQ ID NO: 37942 - protein, 327 aa, Staphylococcus aureus; identical to SEQ ID NO: 30538
  subsp. aureus CIG547

SEQ ID NO: 37943 - protein, 311 aa, Staphylococcus aureus; identical to SEQ ID NO: 30617
  subsp. aureus CIG547

SEQ ID NO: 37944 - protein, 96 aa, Staphylococcus aureus; identical to SEQ ID NO: 30813
  subsp. aureus CIG547

SEQ ID NO: 37945 - protein, 274 aa, Staphylococcus aureus; identical to SEQ ID NO: 30872
  subsp. aureus CIG547

SEQ ID NO: 37946 - protein, 338 aa, Staphylococcus aureus; identical to SEQ ID NO: 30699
  subsp. aureus CIG547

SEQ ID NO: 37947 - protein, 351 aa, Staphylococcus aureus; identical to SEQ ID NO: 30720
  subsp. aureus CIG547

SEQ ID NO: 37948 - protein, 44 aa, Staphylococcus aureus; identical to SEQ ID NO: 30513
  subsp. aureus CIG547

SEQ ID NO: 37949 - protein, 231 aa, Staphylococcus aureus; identical to SEQ ID NO: 31073
  subsp. aureus CIG547

SEQ ID NO: 37950 - protein, 2478 aa, Staphylococcus aureus
  subsp. aureus CIG547
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANESTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITLTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 37951 - protein, 815 aa, Staphylococcus aureus; identical to SEQ ID NO: 31288
  subsp. aureus CIGC128

SEQ ID NO: 37952 - protein, 141 aa, Staphylococcus aureus; identical to SEQ ID NO: 30633
  subsp. aureus CIGC128

SEQ ID NO: 37953 - protein, 690 aa, Staphylococcus aureus; identical to SEQ ID NO: 31345
  subsp. aureus CIGC128

SEQ ID NO: 37954 - protein, 309 aa, Staphylococcus aureus; identical to SEQ ID NO: 30406
  subsp. aureus CIGC128

SEQ ID NO: 37955 - protein, 315 aa, Staphylococcus aureus; identical to SEQ ID NO: 30573
  subsp. aureus CIGC128

SEQ ID NO: 37956 - protein, 325 aa, Staphylococcus aureus; identical to SEQ ID NO: 30407
  subsp. aureus CIGC128

SEQ ID NO: 37957 - protein, 203 aa, Staphylococcus aureus
  subsp. aureus CIGC128
MFKKNDSKNSILLKSILSLGIIYGGAFGIYPKADASTQNSPSVQDKQFQKVEEVPNNSEKALVKKLYDRYSQNTINGKSNKSRNWVYSERPLNENQVRINLEGTYRVADRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 37958 - protein, 731 aa, Staphylococcus aureus
  subsp. aureus CIGC128
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 37959 - protein, 934 aa, Staphylococcus aureus
  subsp. aureus CIGC128
MIVVGMGQEKEAAASEQNNTTVEESGSSATERKASETQTTTNNVNTIDETQSYSATSTEQPSQSTQVTTEEAPTTVQAPKVETSRVDLPSEKVADKETTGTQVDTAQPSNVSEIKPRMKRSTDVTAVTEKEVVEEAKATGTDVTSKVEVEEGSEIVGHNNKETNVVNPHNAERVTLKYKWKFEDGIKPGDYFDFTLSNNVETHGISPLRKVPDIKSKDDNILAVGKVMDERKIRYTFTDYINNKNNLMAELNLNLFIDPTTVTKQGKQTVEVKLGENKISKEFDIKYLDGVKDNWGVTVNGRITLLDKENSKIHHLAYINPKKSDMTSITINGFFAKGGLYTGNVPTVKVYEYLRSDELPESVYANTNDQEKFKDVTNDMSDKLTLSENGSYKLTLDALNKKSYVVSFEGKYNENDKELLFRTNLHGYHANYGYYYYYPVSLTWDNGVAFYSNNAQGDGKDKPNGPIIEKSEPIELDIKSEPPVEKHELTGTIEESNDSKPIDFEYHTAVEGVEGHAEGIIETEEDSIHVDFEESTHENSKHHADVVEYEEDTNPGGGQVITESNLVEFDEESTKGILTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNSVDFEEDTLPQVSGHNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGILFGGLFSILGFALLRRNKKNHKA

SEQ ID NO: 37960 - protein, 992 aa, Staphylococcus aureus; identical to SEQ ID NO: 35171
  subsp. aureus CIGC128

SEQ ID NO: 37961 - protein, 233 aa, Staphylococcus aureus; identical to SEQ ID NO: 30428
  subsp. aureus CIGC128

SEQ ID NO: 37962 - protein, 198 aa, Staphylococcus aureus; identical to SEQ ID NO: 31544
  subsp. aureus CIGC128

SEQ ID NO: 37963 - protein, 901 aa, Staphylococcus aureus
  subsp. aureus CIGC128
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDKTGKNLKTQVIQENVDPATGKDYSIFGWNNENVVRYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSESDSDSDSDSESDSDSDSDSDSDSDSDSDSDSDSDSESDSDSDSDSESDSDSDSDSDSDSDSDSDSDSDSDSDSDSDSDSDSDSESDSDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 37964 - protein, 2275 aa, Staphylococcus aureus
  subsp. aureus CIGC128
MSKRQKEFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSNVAGGGAFGAFVTTDSYGVATTYTSSSTADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSESSSTSASLSDSTSNAISTSESLSESASTSDSISISNSIANSQSASTSKSDSQSTSISLSTSDSKSMSTSESLSDSTSTSGSVSGLLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSASISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSLSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 37965 - protein, 681 aa, Staphylococcus aureus; identical to SEQ ID NO: 32025
  subsp. aureus CIGC128

SEQ ID NO: 37966 - protein, 809 aa, Staphylococcus aureus; identical to SEQ ID NO: 37721
  subsp. aureus CIGC128

SEQ ID NO: 37967 - protein, 241 aa, Staphylococcus aureus; identical to SEQ ID NO: 30411
  subsp. aureus CIGC128

SEQ ID NO: 37968 - protein, 508 aa, Staphylococcus aureus
  subsp. aureus CIGC128
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDGNKPGKEDGNKPGKEDGNKPGKEDNNKPGKEDGNKPGKEDGNKPGKEDNNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 37969 - protein, 241 aa, Staphylococcus aureus; identical to SEQ ID NO: 31350
  subsp. aureus CIGC128

SEQ ID NO: 37970 - protein, 226 aa, Staphylococcus aureus; identical to SEQ ID NO: 31343
  subsp. aureus CIGC128

SEQ ID NO: 37971 - protein, 231 aa, Staphylococcus aureus; identical to SEQ ID NO: 31342
  subsp. aureus CIGC128

SEQ ID NO: 37972 - protein, 356 aa, Staphylococcus aureus
  subsp. aureus CIGC128
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTQQTKMTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEGNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 37973 - protein, 315 aa, Staphylococcus aureus; identical to SEQ ID NO: 31340
  subsp. aureus CIGC128

SEQ ID NO: 37974 - protein, 234 aa, Staphylococcus aureus; identical to SEQ ID NO: 31339
  subsp. aureus CIGC128

SEQ ID NO: 37975 - protein, 232 aa, Staphylococcus aureus; identical to SEQ ID NO: 31338
  subsp. aureus CIGC128

SEQ ID NO: 37976 - protein, 231 aa, Staphylococcus aureus; identical to SEQ ID NO: 31337
  subsp. aureus CIGC128

SEQ ID NO: 37977 - protein, 232 aa, Staphylococcus aureus; identical to SEQ ID NO: 31593
  subsp. aureus CIGC128

SEQ ID NO: 37978 - protein, 232 aa, Staphylococcus aureus; identical to SEQ ID NO: 31335
  subsp. aureus CIGC128

SEQ ID NO: 37979 - protein, 227 aa, Staphylococcus aureus; identical to SEQ ID NO: 31334
  subsp. aureus CIGC128

SEQ ID NO: 37980 - protein, 230 aa, Staphylococcus aureus; identical to SEQ ID NO: 31333
  subsp. aureus CIGC128

SEQ ID NO: 37981 - protein, 434 aa, Staphylococcus aureus [sequence omitted]

SEQ ID NO: 37982 - protein, 946 aa, Staphylococcus aureus
  subsp. aureus CIGC128
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLSAVAADAPAAGKDITNQLTNVTVGIDSGDTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPENSDSDPGSDSGSDSNSDSGSDSGSDSTSDSGSDSASDSDSASDSDSASDSDSASDSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 37983 - protein, 961 aa, Staphylococcus aureus; identical to SEQ ID NO: 36051
  subsp. aureus CIGC128

SEQ ID NO: 37984 - protein, 1369 aa, Staphylococcus aureus
  subsp. aureus CIGC128
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRIAAVQPSSTEAKNVNDLITSNTTLTVVDADKNNKIVPAQDYLELKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDEKGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGRNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 37985 - protein, 1141 aa, Staphylococcus aureus; identical to SEQ ID NO: 31329
  subsp. aureus CIGC128

SEQ ID NO: 37986 - protein, 645 aa, Staphylococcus aureus; identical to SEQ ID NO: 30747
  subsp. aureus CIGC128

SEQ ID NO: 37987 - protein, 350 aa, Staphylococcus aureus
  subsp. aureus CIGC128
MTKHYLNSKYQSEQRSSAMKKITMGTASIILGSLVYIGADSQQVNATTEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 37988 - protein, 105 aa, Staphylococcus aureus; identical to SEQ ID NO: 31317
  subsp. aureus CIGC128

SEQ ID NO: 37989 - protein, 165 aa, Staphylococcus aureus; identical to SEQ ID NO: 31315
  subsp. aureus CIGC128

SEQ ID NO: 37990 - protein, 319 aa, Staphylococcus aureus
  subsp. aureus CIGC128
MKTRIVSSVTTTLLLGSILMNPVANAADSDINIKTGTTDFGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWTDRSSERYKIDWEKEEMTN

SEQ ID NO: 37991 - protein, 238 aa, Staphylococcus aureus; identical to SEQ ID NO: 31313
  subsp. aureus CIGC128

SEQ ID NO: 37992 - protein, 241 aa, Staphylococcus aureus
  subsp. aureus CIGC128
MKKNIMNKLVLSTALLLLGTTSTQLPKTPISFSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 37993 - protein, 372 aa, Staphylococcus aureus; identical to SEQ ID NO: 30609
  subsp. aureus CIGC128

SEQ ID NO: 37994 - protein, 895 aa, Staphylococcus aureus; identical to SEQ ID NO: 31307
  subsp. aureus CIGC128

SEQ ID NO: 37995 - protein, 2186 aa, Staphylococcus aureus
  subsp. aureus CIGC128
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVASNNTTLNVPNKTNENGSGGHLTLKEIQEDVRHSSDKPELVAIAEPASNRPKKRSRRAAPADPNATPADPGAAAAGNGGAPVAITAPYTPTTDPNANNAGQNAPNEVLSFDDNSIRPSTNRSVPSVTVVDNLPGFTLINGGKVGVLSHAMVRTSMFEAGSNRTYQAQGNVLALGRISGTDASNHGDFNGIEKSLTVNPNSELIFEFNTMPTKNGQGATNVIIKNADTNDTIAEKTVEGGPTLRLFKVPDNVRNLKIQFVPKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGSVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNAEVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDTTTNQALNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNKKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVISRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSDRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEEMKVSPKVIQPAPKVCTPIKKEETHESRKVEKELPNTGSEEMDLPLKEFALITGAALLARRRTKNEKES

SEQ ID NO: 37996 - protein, 619 aa, Staphylococcus aureus
  subsp. aureus CIGC128
MNYRDKIQKFSIRKYTVGTFSTVIATLVFLGFNTSQAHAAETNQPASVVKQKQQSNNEQTENRESQVQNSQNSQNSQSLSATHENEQPNISQANLVDQKVAQSSTTNDEQPASQNVNTKKDSATAATTQPDKEEGKHKQNESQSANKNGNDNRAAHLENHEANVVTASDSSDNGNVQHDRNELQAFFDANYHDYRFIDRENADSGTFNYVKGIFEKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPDRSHDFKIRNRSGQVIYSWPTVHVYSLEDLSRASDYFSEAGATAATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYPTNATTNAFRPGGRSGIK

SEQ ID NO: 37997 - protein, 325 aa, Staphylococcus aureus; identical to SEQ ID NO: 30484
  subsp. aureus CIGC128

SEQ ID NO: 37998 - protein, 312 aa, Staphylococcus aureus; identical to SEQ ID NO: 30391
  subsp. aureus CIGC128

SEQ ID NO: 37999 - protein, 234 aa, Staphylococcus aureus; identical to SEQ ID NO: 36037
  subsp. aureus CIGC128

SEQ ID NO: 38000 - protein, 291 aa, Staphylococcus aureus; identical to SEQ ID NO: 30390
  subsp. aureus CIGC128

SEQ ID NO: 38001 - protein, 331 aa, Staphylococcus aureus; identical to SEQ ID NO: 31305
  subsp. aureus CIGC128

SEQ ID NO: 38002 - protein, 327 aa, Staphylococcus aureus; identical to SEQ ID NO: 30538
  subsp. aureus CIGC128

SEQ ID NO: 38003 - protein, 311 aa, Staphylococcus aureus; identical to SEQ ID NO: 30617
  subsp. aureus CIGC128

SEQ ID NO: 38004 - protein, 96 aa, Staphylococcus aureus; identical to SEQ ID NO: 31559
  subsp. aureus CIGC128

SEQ ID NO: 38005 - protein, 274 aa, Staphylococcus aureus; identical to SEQ ID NO: 30872
  subsp. aureus CIGC128

SEQ ID NO: 38006 - protein, 338 aa, Staphylococcus aureus; identical to SEQ ID NO: 31292
  subsp. aureus CIGC128

SEQ ID NO: 38007 - protein, 350 aa, Staphylococcus aureus; identical to SEQ ID NO: 31291
  subsp. aureus CIGC128

SEQ ID NO: 38008 - protein, 44 aa, Staphylococcus aureus; identical to SEQ ID NO: 30451
  subsp. aureus CIGC128

SEQ ID NO: 38009 - protein, 231 aa, Staphylococcus aureus; identical to SEQ ID NO: 31073
  subsp. aureus CIGC128

SEQ ID NO: 38010 - protein, 1795 aa, Staphylococcus aureus; identical to SEQ ID NO: 30558
  subsp. aureus CIGC128

SEQ ID NO: 38011 - protein, 258 aa, Staphylococcus aureus; identical to SEQ ID NO: 30228
  subsp. aureus CIGC340D

SEQ ID NO: 38012 - protein, 268 aa, Staphylococcus aureus; identical to SEQ ID NO: 30398
  subsp. aureus CIGC340D

SEQ ID NO: 38013 - protein, 181 aa, Staphylococcus aureus
  subsp. aureus CIGC340D
MLNKILLLLLSVTFMLLFFSLHSVSAKPDPRPGELNRVSDYKKNKGTMGNVESLYKDKAVIAENVKNTRQFLGHDLIFPIPYSEYKEVKSEFINKKTADKFKDKRLDVFGIPYFYTCLVPKNESREEFIFDGVCIYGGVTMHSTADSISKNIIVPVTVDNKQQFSFTISTNKNGYGTRARL

SEQ ID NO: 38014 - protein, 309 aa, Staphylococcus aureus; identical to SEQ ID NO: 30406
  subsp. aureus CIGC340D

SEQ ID NO: 38015 - protein, 315 aa, Staphylococcus aureus; identical to SEQ ID NO: 30573
  subsp. aureus CIGC340D

SEQ ID NO: 38016 - protein, 325 aa, Staphylococcus aureus; identical to SEQ ID NO: 30407
  subsp. aureus CIGC340D

SEQ ID NO: 38017 - protein, 1115 aa, Staphylococcus aureus
  subsp. aureus CIGC340D
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 38018 - protein, 938 aa, Staphylococcus aureus; identical to SEQ ID NO: 30838
  subsp. aureus CIGC340D

SEQ ID NO: 38019 - protein, 1015 aa, Staphylococcus aureus; identical to SEQ ID NO: 30839
  subsp. aureus CIGC340D

SEQ ID NO: 38020 - protein, 233 aa, Staphylococcus aureus
  subsp. aureus CIGC340D
MKKTIMASSLAVALGVIGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSDVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 38021 - protein, 211 aa, Staphylococcus aureus; identical to SEQ ID NO: 30592
  subsp. aureus CIGC340D

SEQ ID NO: 38022 - protein, 847 aa, Staphylococcus aureus
  subsp. aureus CIGC340D
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 38023 - protein, 2271 aa, Staphylococcus aureus
  subsp. aureus CIGC340D
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSVVDSNSASQSASNSTSTSTSESDSQSTSTYTSQSTSQSESTSTSTSLSDSTSISKSTNQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 38024 - protein, 681 aa, Staphylococcus aureus
  subsp. aureus CIGC340D
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKNSSLNNKNIQRDTTKNNNANPSDVNQGLEQAINDGKQSKVASQQQSKEVDNSQDSNANNNLPSQSLTKEAPSLNKSDQTSQREIVNETEIEKVQPQQNNQANDKITNHNFNNEQEVKPQKDEKTLSVSDLKNNQKSPVEPTKDNDKKNGLNLLKSSAVATLPNKGTKELTAKSKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 38025 - protein, 508 aa, Staphylococcus aureus; identical to SEQ ID NO: 30782
  subsp. aureus CIGC340D

SEQ ID NO: 38026 - protein, 241 aa, Staphylococcus aureus; identical to SEQ ID NO: 30571
  subsp. aureus CIGC340D

SEQ ID NO: 38027 - protein, 691 aa, Staphylococcus aureus; identical to SEQ ID NO: 30511
  subsp. aureus CIGC340D

SEQ ID NO: 38028 - protein, 203 aa, Staphylococcus aureus; identical to SEQ ID NO: 30576
  subsp. aureus CIGC340D

SEQ ID NO: 38029 - protein, 226 aa, Staphylococcus aureus; identical to SEQ ID NO: 30577
  subsp. aureus CIGC340D

SEQ ID NO: 38030 - protein, 231 aa, Staphylococcus aureus; identical to SEQ ID NO: 30578
  subsp. aureus CIGC340D

SEQ ID NO: 38031 - protein, 356 aa, Staphylococcus aureus; identical to SEQ ID NO: 30793
  subsp. aureus CIGC340D

SEQ ID NO: 38032 - protein, 292 aa, Staphylococcus aureus; identical to SEQ ID NO: 30580
  subsp. aureus CIGC340D

SEQ ID NO: 38033 - protein, 234 aa, Staphylococcus aureus; identical to SEQ ID NO: 30581
  subsp. aureus CIGC340D

SEQ ID NO: 38034 - protein, 231 aa, Staphylococcus aureus; identical to SEQ ID NO: 30582
  subsp. aureus CIGC340D

SEQ ID NO: 38035 - protein, 232 aa, Staphylococcus aureus; identical to SEQ ID NO: 30583
  subsp. aureus CIGC340D

SEQ ID NO: 38036 - protein, 232 aa, Staphylococcus aureus; identical to SEQ ID NO: 30584
  subsp. aureus CIGC340D

SEQ ID NO: 38037 - protein, 227 aa, Staphylococcus aureus; identical to SEQ ID NO: 30585
  subsp. aureus CIGC340D

SEQ ID NO: 38038 - protein, 227 aa, Staphylococcus aureus; identical to SEQ ID NO: 30586
  subsp. aureus CIGC340D

SEQ ID NO: 38039 - protein, 809 aa, Staphylococcus aureus; identical to SEQ ID NO: 30632
  subsp. aureus CIGC340D

SEQ ID NO: 38040 - protein, 141 aa, Staphylococcus aureus; identical to SEQ ID NO: 30633
  subsp. aureus CIGC340D

SEQ ID NO: 38041 - protein, 967 aa, Staphylococcus aureus; identical to SEQ ID NO: 34172
  subsp. aureus CIGC340D

SEQ ID NO: 38042 - protein, 1385 aa, Staphylococcus aureus
  subsp. aureus CIGC340D
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATVKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 38043 - protein, 1153 aa, Staphylococcus aureus; identical to SEQ ID NO: 30596
  subsp. aureus CIGC340D

SEQ ID NO: 38044 - protein, 645 aa, Staphylococcus aureus
  subsp. aureus CIGC340D
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKAVKPAAKATNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKILAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 38045 - protein, 350 aa, Staphylococcus aureus; identical to SEQ ID NO: 30602
  subsp. aureus CIGC340D

SEQ ID NO: 38046 - protein, 109 aa, Staphylococcus aureus; identical to SEQ ID NO: 30603
  subsp. aureus CIGC340D

SEQ ID NO: 38047 - protein, 165 aa, Staphylococcus aureus; identical to SEQ ID NO: 30418
  subsp. aureus CIGC340D

SEQ ID NO: 38048 - protein, 319 aa, Staphylococcus aureus; identical to SEQ ID NO: 30605
  subsp. aureus CIGC340D

SEQ ID NO: 38049 - protein, 238 aa, Staphylococcus aureus; identical to SEQ ID NO: 30606
  subsp. aureus CIGC340D

SEQ ID NO: 38050 - protein, 241 aa, Staphylococcus aureus; identical to SEQ ID NO: 30607
  subsp. aureus CIGC340D

SEQ ID NO: 38051 - protein, 241 aa, Staphylococcus aureus; identical to SEQ ID NO: 30608
  subsp. aureus CIGC340D

SEQ ID NO: 38052 - protein, 372 aa, Staphylococcus aureus; identical to SEQ ID NO: 30609
  subsp. aureus CIGC340D

SEQ ID NO: 38053 - protein, 434 aa, Staphylococcus aureus [sequence omitted]

SEQ ID NO: 38054 - protein, 971 aa, Staphylococcus aureus
  subsp. aureus CIGC340D
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 38055 - protein, 62 aa, Staphylococcus aureus; identical to SEQ ID NO: 30610
  subsp. aureus CIGC340D

SEQ ID NO: 38056 - protein, 138 aa, Staphylococcus aureus; identical to SEQ ID NO: 30785
  subsp. aureus CIGC340D

SEQ ID NO: 38057 - protein, 291 aa, Staphylococcus aureus; identical to SEQ ID NO: 30390
  subsp. aureus CIGC340D

SEQ ID NO: 38058 - protein, 891 aa, Staphylococcus aureus
  subsp. aureus CIGC340D
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGCEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 38059 - protein, 2186 aa, Staphylococcus aureus; identical to SEQ ID NO: 30516
  subsp. aureus CIGC340D

SEQ ID NO: 38060 - protein, 331 aa, Staphylococcus aureus
  subsp. aureus CIGC340D
MSNQFKSEEERRQWEQFQAFQNQQNQQHQQYGQKKSKKGWFWGCGGCLVLFILIIIGISACTAGVTGNLGGNSSKEANKTHKIGETVKNGDLEVTVNSVETMKSVGPSLAPTNAKGIFVVADVTIKNKGKEALTIDSSMFKLKSGDKTFEADNTVSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETATVEPMPQSKPTTSEAPPSQNNHNENNMYDASTE

SEQ ID NO: 38061 - protein, 327 aa, Staphylococcus aureus
  subsp. aureus CIGC340D
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSYKQNDTKKSKIKVTYQREMDRYTNQWNRLHWIGNNYKNQNTVTFTSTYEVDWQNHTVKLIGTDSKETNPGV

SEQ ID NO: 38062 - protein, 311 aa, Staphylococcus aureus; identical to SEQ ID NO: 30617
  subsp. aureus CIGC340D

SEQ ID NO: 38063 - protein, 258 aa, Staphylococcus aureus; identical to SEQ ID NO: 30410
  subsp. aureus CIGC340D

SEQ ID NO: 38064 - protein, 165 aa, Staphylococcus aureus; identical to SEQ ID NO: 30805
  subsp. aureus CIGC340D

SEQ ID NO: 38065 - protein, 131 aa, Staphylococcus aureus; identical to SEQ ID NO: 30867
  subsp. aureus CIGC340D

SEQ ID NO: 38066 - protein, 242 aa, Staphylococcus aureus; identical to SEQ ID NO: 30399
  subsp. aureus CIGC340D

SEQ ID NO: 38067 - protein, 239 aa, Staphylococcus aureus; identical to SEQ ID NO: 30622
  subsp. aureus CIGC340D

SEQ ID NO: 38068 - protein, 254 aa, Staphylococcus aureus; identical to SEQ ID NO: 30809
  subsp. aureus CIGC340D

SEQ ID NO: 38069 - protein, 274 aa, Staphylococcus aureus; identical to SEQ ID NO: 30872
  subsp. aureus CIGC340D

SEQ ID NO: 38070 - protein, 338 aa, Staphylococcus aureus; identical to SEQ ID NO: 30627
  subsp. aureus CIGC340D

SEQ ID NO: 38071 - protein, 351 aa, Staphylococcus aureus; identical to SEQ ID NO: 30628
  subsp. aureus CIGC340D

SEQ ID NO: 38072 - protein, 44 aa, Staphylococcus aureus; identical to SEQ ID NO: 30513
  subsp. aureus CIGC340D

SEQ ID NO: 38073 - protein, 260 aa, Staphylococcus aureus; identical to SEQ ID NO: 30625
  subsp. aureus CIGC340D

SEQ ID NO: 38074 - protein, 231 aa, Staphylococcus aureus; identical to SEQ ID NO: 30630
  subsp. aureus CIGC340D

SEQ ID NO: 38075 - protein, 2481 aa, Staphylococcus aureus; identical to SEQ ID NO: 31413
  subsp. aureus CIGC340D

SEQ ID NO: 38076 - protein, 808 aa, Staphylococcus aureus; identical to SEQ ID NO: 31215
  subsp. aureus CIGC341D

SEQ ID NO: 38077 - protein, 141 aa, Staphylococcus aureus; identical to SEQ ID NO: 31214
  subsp. aureus CIGC341D

SEQ ID NO: 38078 - protein, 309 aa, Staphylococcus aureus; identical to SEQ ID NO: 33946
  subsp. aureus CIGC341D

SEQ ID NO: 38079 - protein, 315 aa, Staphylococcus aureus; identical to SEQ ID NO: 31191
  subsp. aureus CIGC341D

SEQ ID NO: 38080 - protein, 323 aa, Staphylococcus aureus; identical to SEQ ID NO: 37302
  subsp. aureus CIGC341D

SEQ ID NO: 38081 - protein, 942 aa, Staphylococcus aureus; identical to SEQ ID NO: 35550
  subsp. aureus CIGC341D

SEQ ID NO: 38082 - protein, 233 aa, Staphylococcus aureus; identical to SEQ ID NO: 31039
  subsp. aureus CIGC341D

SEQ ID NO: 38083 - protein, 860 aa, Staphylococcus aureus
  subsp. aureus CIGC341D
MSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSDSDSDSDSDSDSDSDSNSDSDSDSDSDSDSDSDSDSDSDSESDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 38084 - protein, 1314 aa, Staphylococcus aureus
  subsp. aureus CIGC341D
MFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSTSGSTSTSTSESLSMSGSDSTSVSDSTSMSESDSTSVSMSQDKSDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 38085 - protein, 681 aa, Staphylococcus aureus; identical to SEQ ID NO: 34710
  subsp. aureus CIGC341D

SEQ ID NO: 38086 - protein, 801 aa, Staphylococcus aureus
  subsp. aureus CIGC341D
MVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 38087 - protein, 516 aa, Staphylococcus aureus; identical to SEQ ID NO: 31270
  subsp. aureus CIGC341D

SEQ ID NO: 38088 - protein, 691 aa, Staphylococcus aureus; identical to SEQ ID NO: 31040
  subsp. aureus CIGC341D

SEQ ID NO: 38089 - protein, 226 aa, Staphylococcus aureus; identical to SEQ ID NO: 31265
  subsp. aureus CIGC341D

SEQ ID NO: 38090 - protein, 231 aa, Staphylococcus aureus; identical to SEQ ID NO: 35706
  subsp. aureus CIGC341D

SEQ ID NO: 38091 - protein, 343 aa, Staphylococcus aureus; identical to SEQ ID NO: 31263
  subsp. aureus CIGC341D

SEQ ID NO: 38092 - protein, 306 aa, Staphylococcus aureus; identical to SEQ ID NO: 31262
  subsp. aureus CIGC341D

SEQ ID NO: 38093 - protein, 234 aa, Staphylococcus aureus; identical to SEQ ID NO: 30567
  subsp. aureus CIGC341D

SEQ ID NO: 38094 - protein, 231 aa, Staphylococcus aureus; identical to SEQ ID NO: 30566
  subsp. aureus CIGC341D

SEQ ID NO: 38095 - protein, 232 aa, Staphylococcus aureus; identical to SEQ ID NO: 30565
  subsp. aureus CIGC341D

SEQ ID NO: 38096 - protein, 227 aa, Staphylococcus aureus; identical to SEQ ID NO: 30564
  subsp. aureus CIGC341D

SEQ ID NO: 38097 - protein, 232 aa, Staphylococcus aureus; identical to SEQ ID NO: 31257
  subsp. aureus CIGC341D

SEQ ID NO: 38098 - protein, 434 aa, Staphylococcus aureus [sequence omitted]

SEQ ID NO: 38099 - protein, 1029 aa, Staphylococcus aureus; identical to SEQ ID NO: 31250
  subsp. aureus CIGC341D

SEQ ID NO: 38100 - protein, 912 aa, Staphylococcus aureus
  subsp. aureus CIGC341D
MIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSESDSDSDSDSDSDSDSDSDSDSDSDSDSDSDSDSDSESDSDSDSDSESDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 38101 - protein, 1345 aa, Staphylococcus aureus
  subsp. aureus CIGC341D
MGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 38102 - protein, 1123 aa, Staphylococcus aureus
  subsp. aureus CIGC341D
MISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 38103 - protein, 68 aa, Staphylococcus aureus; identical to SEQ ID NO: 35850
  subsp. aureus CIGC341D

SEQ ID NO: 38104 - protein, 167 aa, Staphylococcus aureus; identical to SEQ ID NO: 31885
  subsp. aureus CIGC341D

SEQ ID NO: 38105 - protein, 270 aa, Staphylococcus aureus; identical to SEQ ID NO: 35140
  subsp. aureus CIGC341D

SEQ ID NO: 38106 - protein, 44 aa, Staphylococcus aureus; identical to SEQ ID NO: 30513
  subsp. aureus CIGC341D

SEQ ID NO: 38107 - protein, 228 aa, Staphylococcus aureus
  subsp. aureus CIGC341D
MNFFIVSPLLLATIATDFTPVPLLSNQIIKTAKASTNDNIKDLLDWYSSGSDTFTNSEVLDNSLGSMRIKNTDGSISLIIFPSPYYSPAFTKGEKVDLNTKRTKKSQHTSEGTYIHFQISGVTNTEKLPTPIELPLKVKVHGKDSPLKYWPKFDKKQLAISTLDFEIRHQLTQIHGLYRSSDKTGGYWKITMNDGSTYQSDLSKKFEYNTEKPPINIDEIKTIEAEIN

SEQ ID NO: 38108 - protein, 351 aa, Staphylococcus aureus; identical to SEQ ID NO: 31218
  subsp. aureus CIGC341D

SEQ ID NO: 38109 - protein, 339 aa, Staphylococcus aureus; identical to SEQ ID NO: 31219
  subsp. aureus CIGC341D

SEQ ID NO: 38110 - protein, 231 aa, Staphylococcus aureus; identical to SEQ ID NO: 36931
  subsp. aureus CIGC341D

SEQ ID NO: 38111 - protein, 652 aa, Staphylococcus aureus; identical to SEQ ID NO: 34746
  subsp. aureus CIGC341D

SEQ ID NO: 38112 - protein, 354 aa, Staphylococcus aureus; identical to SEQ ID NO: 30412
  subsp. aureus CIGC341D

SEQ ID NO: 38113 - protein, 105 aa, Staphylococcus aureus; identical to SEQ ID NO: 31168
  subsp. aureus CIGC341D

SEQ ID NO: 38114 - protein, 165 aa, Staphylococcus aureus; identical to SEQ ID NO: 31241
  subsp. aureus CIGC341D

SEQ ID NO: 38115 - protein, 206 aa, Staphylococcus aureus; identical to SEQ ID NO: 34750
  subsp. aureus CIGC341D

SEQ ID NO: 38116 - protein, 112 aa, Staphylococcus aureus; identical to SEQ ID NO: 34751
  subsp. aureus CIGC341D

SEQ ID NO: 38117 - protein, 233 aa, Staphylococcus aureus
  subsp. aureus CIGC341D
MKKLILMTTLLLLGTTATQTSNSPLNVSTDAKAYHIGQDETNINELIKYYTQLPLTFSNRWLYQYDDGNIYVEFKRYSWSAHIRLWGAESWGNVNQLRDRYVDVFGLKDEDTSQLWWVYRDTFTGGVTPAASPSDKPYSLFVQYKDKLQTIIGAHKMYQGNKPILTLKEIDFRARETLIKNKILYHENRNKGKLKITGGGNDFTIDLSKRLHSDLANVYVKNPQKITVEVLID

SEQ ID NO: 38118 - protein, 210 aa, Staphylococcus aureus
  subsp. aureus CIGC341D
MSSEAKAYNISESETNVNELTKYYTQRHLTFSNKWLWQKDNGTIHATLLQLSWFSHIQVFGPESWGNINQLRNKYVDIFALKDYETWRTYMLAQETFTGGVTPVAKPSDKHYKLNVTYKDKAGTFIGEYQFYTGNKPVLTLKEVDFRIRQTLIKNKKLYNGDYNKGHIKITGGSNNYTIDLSKRLKSTDANRYVKNPQTAHIEILLEKSS

SEQ ID NO: 38119 - protein, 241 aa, Staphylococcus aureus; identical to SEQ ID NO: 31238
  subsp. aureus CIGC341D

SEQ ID NO: 38120 - protein, 372 aa, Staphylococcus aureus; identical to SEQ ID NO: 33950
  subsp. aureus CIGC341D

SEQ ID NO: 38121 - protein, 278 aa, Staphylococcus aureus; identical to SEQ ID NO: 34714
  subsp. aureus CIGC341D

SEQ ID NO: 38122 - protein, 331 aa, Staphylococcus aureus; identical to SEQ ID NO: 31235
  subsp. aureus CIGC341D

SEQ ID NO: 38123 - protein, 806 aa, Staphylococcus aureus; identical to SEQ ID NO: 31234
  subsp. aureus CIGC341D

SEQ ID NO: 38124 - protein, 212 aa, Staphylococcus aureus
  subsp. aureus CIGC341D
MGNVMNLYMSPPVEGRGVINSRQFLSHDLIFPIEYKSYNEVKTELENTELANNYKGKKVDIFGVPYFYTCIIPKSEPDINQNFGGCCMYGGLTFNSSENERDKLITVQVTIDNRQSLGFTITTNKNMVTIQELDYKARHWLTKEKKLYEFDGSAFESGYIKFTEKNNTSFWFDLFPKKELVPFVPYKFLNIYGDNKVVDSKSIKMEVFLNTH

SEQ ID NO: 38125 - protein, 251 aa, Staphylococcus aureus; identical to SEQ ID NO: 30505
  subsp. aureus CIGC341D

SEQ ID NO: 38126 - protein, 243 aa, Staphylococcus aureus; identical to SEQ ID NO: 33974
  subsp. aureus CIGC341D

SEQ ID NO: 38127 - protein, 242 aa, Staphylococcus aureus; identical to SEQ ID NO: 30522
  subsp. aureus CIGC341D

SEQ ID NO: 38128 - protein, 239 aa, Staphylococcus aureus; identical to SEQ ID NO: 30171
  subsp. aureus CIGC341D

SEQ ID NO: 38129 - protein, 254 aa, Staphylococcus aureus; identical to SEQ ID NO: 31226
  subsp. aureus CIGC341D

SEQ ID NO: 38130 - protein, 689 aa, Staphylococcus aureus; identical to SEQ ID NO: 31224
  subsp. aureus CIGC341D

SEQ ID NO: 38131 - protein, 257 aa, Staphylococcus aureus; identical to SEQ ID NO: 31220
  subsp. aureus CIGC341D

SEQ ID NO: 38132 - protein, 231 aa, Staphylococcus aureus; identical to SEQ ID NO: 31216
  subsp. aureus CIGC341D

SEQ ID NO: 38133 - protein, 790 aa, Staphylococcus aureus
  subsp. aureus CIGC345D
MAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 38134 - protein, 141 aa, Staphylococcus aureus; identical to SEQ ID NO: 30715
  subsp. aureus CIGC345D

SEQ ID NO: 38135 - protein, 309 aa, Staphylococcus aureus; identical to SEQ ID NO: 30406
  subsp. aureus CIGC345D

SEQ ID NO: 38136 - protein, 315 aa, Staphylococcus aureus; identical to SEQ ID NO: 30440
  subsp. aureus CIGC345D

SEQ ID NO: 38137 - protein, 236 aa, Staphylococcus aureus; identical to SEQ ID NO: 35120
  subsp. aureus CIGC345D

SEQ ID NO: 38138 - protein, 933 aa, Staphylococcus aureus; identical to SEQ ID NO: 30755
  subsp. aureus CIGC345D

SEQ ID NO: 38139 - protein, 434 aa, Staphylococcus aureus [sequence omitted]

SEQ ID NO: 38140 - protein, 1154 aa, Staphylococcus aureus
  subsp. aureus CIGC345D
MISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 38141 - protein, 1383 aa, Staphylococcus aureus
  subsp. aureus CIGC345D
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 38142 - protein, 953 aa, Staphylococcus aureus
  subsp. aureus CIGC345D
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 38143 - protein, 225 aa, Staphylococcus aureus
  subsp. aureus CIGC345D
MKLKNIAKASLALGILTIGMITTTAQPVKASTLEVRSQATQDLSEYYNRPFFEYTNQSGYKEEGKVTFTPNYQLIDVTLTGNEKQNFGEDISNVDIFVVRENSDRSGNTASIGGITKTNGSNYIDKVKDVNLIITKNIDSVTSTSTSSTYTINKEEISLKELDFKLRKHLIDKHNLYKTEPKDSKIRITMKDGGFYTFELNKKLQTHRMGDVIDGRNIEKIEVNL

SEQ ID NO: 38144 - protein, 241 aa, Staphylococcus aureus; identical to SEQ ID NO: 30776
  subsp. aureus CIGC345D

SEQ ID NO: 38145 - protein, 484 aa, Staphylococcus aureus
  subsp. aureus CIGC345D
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38146 - protein, 681 aa, Staphylococcus aureus; identical to SEQ ID NO: 32025
  subsp. aureus CIGC345D

SEQ ID NO: 38147 - protein, 2271 aa, Staphylococcus aureus
  subsp. aureus CIGC345D
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSGSVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 38148 - protein, 907 aa, Staphylococcus aureus
  subsp. aureus CIGC345D
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 38149 - protein, 233 aa, Staphylococcus aureus; identical to SEQ ID NO: 30428
  subsp. aureus CIGC345D

SEQ ID NO: 38150 - protein, 995 aa, Staphylococcus aureus
  subsp. aureus CIGC345D
MIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVSAEPGKPVPPAKEEPKKPSKPVEQGKVVTPVIEINEKVKAVAPTKKPQSKKSELPETGGEESTNKGMLFGGLFSILGLTLLRRNKKNHKA

SEQ ID NO: 38151 - protein, 917 aa, Staphylococcus aureus; identical to SEQ ID NO: 31037
  subsp. aureus CIGC345D

SEQ ID NO: 38152 - protein, 987 aa, Staphylococcus aureus
  subsp. aureus CIGC345D
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 38153 - protein, 645 aa, Staphylococcus aureus; identical to SEQ ID NO: 30747
  subsp. aureus CIGC345D

SEQ ID NO: 38154 - protein, 350 aa, Staphylococcus aureus; identical to SEQ ID NO: 30602
  subsp. aureus CIGC345D

SEQ ID NO: 38155 - protein, 109 aa, Staphylococcus aureus; identical to SEQ ID NO: 30603
  subsp. aureus CIGC345D

SEQ ID NO: 38156 - protein, 165 aa, Staphylococcus aureus; identical to SEQ ID NO: 30742
  subsp. aureus CIGC345D

SEQ ID NO: 38157 - protein, 319 aa, Staphylococcus aureus; identical to SEQ ID NO: 30741
  subsp. aureus CIGC345D

SEQ ID NO: 38158 - protein, 238 aa, Staphylococcus aureus; identical to SEQ ID NO: 30740
  subsp. aureus CIGC345D

SEQ ID NO: 38159 - protein, 241 aa, Staphylococcus aureus; identical to SEQ ID NO: 30739
  subsp. aureus CIGC345D

SEQ ID NO: 38160 - protein, 241 aa, Staphylococcus aureus; identical to SEQ ID NO: 30738
  subsp. aureus CIGC345D

SEQ ID NO: 38161 - protein, 372 aa, Staphylococcus aureus; identical to SEQ ID NO: 31084
  subsp. aureus CIGC345D

SEQ ID NO: 38162 - protein, 227 aa, Staphylococcus aureus; identical to SEQ ID NO: 30585
  subsp. aureus CIGC345D

SEQ ID NO: 38163 - protein, 232 aa, Staphylococcus aureus; identical to SEQ ID NO: 30765
  subsp. aureus CIGC345D

SEQ ID NO: 38164 - protein, 232 aa, Staphylococcus aureus; identical to SEQ ID NO: 31054
  subsp. aureus CIGC345D

SEQ ID NO: 38165 - protein, 231 aa, Staphylococcus aureus; identical to SEQ ID NO: 30560
  subsp. aureus CIGC345D

SEQ ID NO: 38166 - protein, 231 aa, Staphylococcus aureus; identical to SEQ ID NO: 31761
  subsp. aureus CIGC345D

SEQ ID NO: 38167 - protein, 234 aa, Staphylococcus aureus; identical to SEQ ID NO: 31052
  subsp. aureus CIGC345D

SEQ ID NO: 38168 - protein, 320 aa, Staphylococcus aureus
  subsp. aureus CIGC345D
MKITTIAKTSLALGLLTTGVITTTTQAANATTPSSTKVEAPQSTPPSTKIEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 38169 - protein, 356 aa, Staphylococcus aureus; identical to SEQ ID NO: 31755
  subsp. aureus CIGC345D

SEQ ID NO: 38170 - protein, 231 aa, Staphylococcus aureus; identical to SEQ ID NO: 30768
  subsp. aureus CIGC345D

SEQ ID NO: 38171 - protein, 226 aa, Staphylococcus aureus; identical to SEQ ID NO: 30769
  subsp. aureus CIGC345D

SEQ ID NO: 38172 - protein, 203 aa, Staphylococcus aureus; identical to SEQ ID NO: 30770
  subsp. aureus CIGC345D

SEQ ID NO: 38173 - protein, 690 aa, Staphylococcus aureus
  subsp. aureus CIGC345D
MLRGQEERKYSIRKYSIGVVSVLAATMFVVSSHEAQASEKTSTNAAAQKETLNQPGEQGNAITSHQMQSGKQLDDMHKEDGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 38174 - protein, 291 aa, Staphylococcus aureus; identical to SEQ ID NO: 30390
  subsp. aureus CIGC345D

SEQ ID NO: 38175 - protein, 250 aa, Staphylococcus aureus; identical to SEQ ID NO: 31910
  subsp. aureus CIGC345D

SEQ ID NO: 38176 - protein, 895 aa, Staphylococcus aureus; identical to SEQ ID NO: 30734
  subsp. aureus CIGC345D

SEQ ID NO: 38177 - protein, 2186 aa, Staphylococcus aureus
  subsp. aureus CIGC345D
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 38178 - protein, 331 aa, Staphylococcus aureus; identical to SEQ ID NO: 30732
  subsp. aureus CIGC345D

SEQ ID NO: 38179 - protein, 327 aa, Staphylococcus aureus
  subsp. aureus CIGC345D
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLERGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 38180 - protein, 306 aa, Staphylococcus aureus; identical to SEQ ID NO: 30803
  subsp. aureus CIGC345D

SEQ ID NO: 38181 - protein, 684 aa, Staphylococcus aureus; identical to SEQ ID NO: 33787
  subsp. aureus CIGC345D

SEQ ID NO: 38182 - protein, 216 aa, Staphylococcus aureus
  subsp. aureus CIGC345D
MQGTALSNLRQTYYHNGSAIIENKESNDQFLKNTILFNDFFTGHQWYNDLLVDLGSKDTANIYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTQLRIYRDNKTIKSKNMHIDIYLYTT

SEQ ID NO: 38183 - protein, 274 aa, Staphylococcus aureus; identical to SEQ ID NO: 30872
  subsp. aureus CIGC345D

SEQ ID NO: 38184 - protein, 338 aa, Staphylococcus aureus; identical to SEQ ID NO: 30699
  subsp. aureus CIGC345D

SEQ ID NO: 38185 - protein, 351 aa, Staphylococcus aureus; identical to SEQ ID NO: 30720
  subsp. aureus CIGC345D

SEQ ID NO: 38186 - protein, 45 aa, Staphylococcus aureus; identical to SEQ ID NO: 31097
  subsp. aureus CIGC345D

SEQ ID NO: 38187 - protein, 231 aa, Staphylococcus aureus; identical to SEQ ID NO: 31073
  subsp. aureus CIGC345D

SEQ ID NO: 38188 - protein, 2478 aa, Staphylococcus aureus; identical to SEQ ID NO: 31939
  subsp. aureus CIGC345D

SEQ ID NO: 38189 - protein, 309 aa, Staphylococcus aureus; identical to SEQ ID NO: 30406
  subsp. aureus CIGC348

SEQ ID NO: 38190 - protein, 315 aa, Staphylococcus aureus; identical to SEQ ID NO: 30573
  subsp. aureus CIGC348

SEQ ID NO: 38191 - protein, 325 aa, Staphylococcus aureus; identical to SEQ ID NO: 30407
  subsp. aureus CIGC348

SEQ ID NO: 38192 - protein, 859 aa, Staphylococcus aureus
  subsp. aureus CIGC348
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 38193 - protein, 933 aa, Staphylococcus aureus
  subsp. aureus CIGC348
MGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 38194 - protein, 1010 aa, Staphylococcus aureus; identical to SEQ ID NO: 36943
  subsp. aureus CIGC348

SEQ ID NO: 38195 - protein, 233 aa, Staphylococcus aureus; identical to SEQ ID NO: 30591
  subsp. aureus CIGC348

SEQ ID NO: 38196 - protein, 211 aa, Staphylococcus aureus; identical to SEQ ID NO: 30592
  subsp. aureus CIGC348

SEQ ID NO: 38197 - protein, 870 aa, Staphylococcus aureus; identical to SEQ ID NO: 37542
  subsp. aureus CIGC348

SEQ ID NO: 38198 - protein, 2271 aa, Staphylococcus aureus; identical to SEQ ID NO: 30597
  subsp. aureus CIGC348

SEQ ID NO: 38199 - protein, 681 aa, Staphylococcus aureus; identical to SEQ ID NO: 30598
  subsp. aureus CIGC348

SEQ ID NO: 38200 - protein, 809 aa, Staphylococcus aureus; identical to SEQ ID NO: 30632
  subsp. aureus CIGC348

SEQ ID NO: 38201 - protein, 141 aa, Staphylococcus aureus; identical to SEQ ID NO: 30633
  subsp. aureus CIGC348

SEQ ID NO: 38202 - protein, 508 aa, Staphylococcus aureus; identical to SEQ ID NO: 30782
  subsp. aureus CIGC348

SEQ ID NO: 38203 - protein, 241 aa, Staphylococcus aureus; identical to SEQ ID NO: 30571
  subsp. aureus CIGC348

SEQ ID NO: 38204 - protein, 645 aa, Staphylococcus aureus; identical to SEQ ID NO: 30908
  subsp. aureus CIGC348

SEQ ID NO: 38205 - protein, 203 aa, Staphylococcus aureus; identical to SEQ ID NO: 30576
  subsp. aureus CIGC348

SEQ ID NO: 38206 - protein, 226 aa, Staphylococcus aureus; identical to SEQ ID NO: 30577
  subsp. aureus CIGC348

SEQ ID NO: 38207 - protein, 231 aa, Staphylococcus aureus; identical to SEQ ID NO: 30578
  subsp. aureus CIGC348

SEQ ID NO: 38208 - protein, 356 aa, Staphylococcus aureus; identical to SEQ ID NO: 30579
  subsp. aureus CIGC348

SEQ ID NO: 38209 - protein, 292 aa, Staphylococcus aureus; identical to SEQ ID NO: 30580
  subsp. aureus CIGC348

SEQ ID NO: 38210 - protein, 234 aa, Staphylococcus aureus; identical to SEQ ID NO: 30581
  subsp. aureus CIGC348

SEQ ID NO: 38211 - protein, 231 aa, Staphylococcus aureus; identical to SEQ ID NO: 30582
  subsp. aureus CIGC348

SEQ ID NO: 38212 - protein, 232 aa, Staphylococcus aureus; identical to SEQ ID NO: 30583
  subsp. aureus CIGC348

SEQ ID NO: 38213 - protein, 232 aa, Staphylococcus aureus; identical to SEQ ID NO: 30584
  subsp. aureus CIGC348

SEQ ID NO: 38214 - protein, 227 aa, Staphylococcus aureus; identical to SEQ ID NO: 30585
  subsp. aureus CIGC348

SEQ ID NO: 38215 - protein, 227 aa, Staphylococcus aureus; identical to SEQ ID NO: 30586
  subsp. aureus CIGC348

SEQ ID NO: 38216 - protein, 961 aa, Staphylococcus aureus
  subsp. aureus CIGC348
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 38217 - protein, 1308 aa, Staphylococcus aureus
  subsp. aureus CIGC348
MGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 38218 - protein, 1153 aa, Staphylococcus aureus; identical to SEQ ID NO: 30596
  subsp. aureus CIGC348

SEQ ID NO: 38219 - protein, 291 aa, Staphylococcus aureus; identical to SEQ ID NO: 30390
  subsp. aureus CIGC348

SEQ ID NO: 38220 - protein, 434 aa, Staphylococcus aureus [sequence omitted]

SEQ ID NO: 38221 - protein, 903 aa, Staphylococcus aureus
  subsp. aureus CIGC348
MKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 38222 - protein, 44 aa, Staphylococcus aureus; identical to SEQ ID NO: 30513
  subsp. aureus CIGC348

SEQ ID NO: 38223 - protein, 351 aa, Staphylococcus aureus; identical to SEQ ID NO: 30628
  subsp. aureus CIGC348

SEQ ID NO: 38224 - protein, 338 aa, Staphylococcus aureus; identical to SEQ ID NO: 30627
  subsp. aureus CIGC348

SEQ ID NO: 38225 - protein, 274 aa, Staphylococcus aureus; identical to SEQ ID NO: 30815
  subsp. aureus CIGC348

SEQ ID NO: 38226 - protein, 96 aa, Staphylococcus aureus; identical to SEQ ID NO: 30813
  subsp. aureus CIGC348

SEQ ID NO: 38227 - protein, 645 aa, Staphylococcus aureus; identical to SEQ ID NO: 30601
  subsp. aureus CIGC348

SEQ ID NO: 38228 - protein, 350 aa, Staphylococcus aureus; identical to SEQ ID NO: 30602
  subsp. aureus CIGC348

SEQ ID NO: 38229 - protein, 109 aa, Staphylococcus aureus; identical to SEQ ID NO: 30603
  subsp. aureus CIGC348

SEQ ID NO: 38230 - protein, 165 aa, Staphylococcus aureus; identical to SEQ ID NO: 30418
  subsp. aureus CIGC348

SEQ ID NO: 38231 - protein, 319 aa, Staphylococcus aureus; identical to SEQ ID NO: 30605
  subsp. aureus CIGC348

SEQ ID NO: 38232 - protein, 238 aa, Staphylococcus aureus; identical to SEQ ID NO: 30606
  subsp. aureus CIGC348

SEQ ID NO: 38233 - protein, 241 aa, Staphylococcus aureus; identical to SEQ ID NO: 30607
  subsp. aureus CIGC348

SEQ ID NO: 38234 - protein, 241 aa, Staphylococcus aureus; identical to SEQ ID NO: 30608
  subsp. aureus CIGC348

SEQ ID NO: 38235 - protein, 372 aa, Staphylococcus aureus; identical to SEQ ID NO: 30609
  subsp. aureus CIGC348

SEQ ID NO: 38236 - protein, 62 aa, Staphylococcus aureus; identical to SEQ ID NO: 30610
  subsp. aureus CIGC348

SEQ ID NO: 38237 - protein, 138 aa, Staphylococcus aureus; identical to SEQ ID NO: 30785
  subsp. aureus CIGC348

SEQ ID NO: 38238 - protein, 891 aa, Staphylococcus aureus; identical to SEQ ID NO: 30788
  subsp. aureus CIGC348

SEQ ID NO: 38239 - protein, 2186 aa, Staphylococcus aureus; identical to SEQ ID NO: 30789
  subsp. aureus CIGC348

SEQ ID NO: 38240 - protein, 331 aa, Staphylococcus aureus; identical to SEQ ID NO: 30615
  subsp. aureus CIGC348

SEQ ID NO: 38241 - protein, 325 aa, Staphylococcus aureus
  subsp. aureus CIGC348
MKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 38242 - protein, 311 aa, Staphylococcus aureus; identical to SEQ ID NO: 30617
  subsp. aureus CIGC348

SEQ ID NO: 38243 - protein, 258 aa, Staphylococcus aureus; identical to SEQ ID NO: 30410
  subsp. aureus CIGC348

SEQ ID NO: 38244 - protein, 251 aa, Staphylococcus aureus; identical to SEQ ID NO: 30946
  subsp. aureus CIGC348

SEQ ID NO: 38245 - protein, 131 aa, Staphylococcus aureus; identical to SEQ ID NO: 30867
  subsp. aureus CIGC348

SEQ ID NO: 38246 - protein, 242 aa, Staphylococcus aureus; identical to SEQ ID NO: 30399
  subsp. aureus CIGC348

SEQ ID NO: 38247 - protein, 181 aa, Staphylococcus aureus; identical to SEQ ID NO: 36678
  subsp. aureus CIGC348

SEQ ID NO: 38248 - protein, 254 aa, Staphylococcus aureus; identical to SEQ ID NO: 30809
  subsp. aureus CIGC348

SEQ ID NO: 38249 - protein, 231 aa, Staphylococcus aureus; identical to SEQ ID NO: 30630
  subsp. aureus CIGC348

SEQ ID NO: 38250 - protein, 2481 aa, Staphylococcus aureus; identical to SEQ ID NO: 30631
  subsp. aureus CIGC348

SEQ ID NO: 38251 - protein, 258 aa, Staphylococcus aureus; identical to SEQ ID NO: 30228
  subsp. aureus CIGC348

SEQ ID NO: 38252 - protein, 268 aa, Staphylococcus aureus; identical to SEQ ID NO: 30398
  subsp. aureus CIGC348

SEQ ID NO: 38253 - protein, 259 aa, Staphylococcus aureus; identical to SEQ ID NO: 30226
  subsp. aureus CIGC348

SEQ ID NO: 38254 - protein, 807 aa, Staphylococcus aureus
  subsp. aureus CIGC93
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKT

SEQ ID NO: 38255 - protein, 939 aa, Staphylococcus aureus
  subsp. aureus CIGC93
MIVVGMGQEKEAAASEQNNTTVEESGSSATESKASETQTTTNNVNTIDETHSYSATSTEQPSQSTQVTTEEAPKTVQAPKVETSRVDLPSEKVADKETTGTQVDTAQPSNVSEIKPRMKRSADGAVVPEKEVVEEAKGTGIDVTSKVKVTESSLEGHNKDSNIVNPHNAQRVTLKYKWKFGEGIKAGDYFDFTLSDNVETHGISTLRKVPEIKSSTEDKVMANGQVIDERKIRYTFTDYINNKNDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQNANNPTVKVYKHIGSDELAESVYAKLDDANKFEDVTNKVNLSYTGDGGYSLNFNDLDNTKNYVIKYEGEYNQNAKDLNFRTHLSGYHKNYPYYPYYPYYPVQLTWNNGVAFYSNNAQGDGKDKPKEPIIEHSTPIELEFKSEQPVEKHELTGTIEESNDSKPIDFEYHTAVEGAEGHAEGIIETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENYQHISHSGLGTENGHGNYGVIEEIEENSHVDIKSELGYEGGQNSGNQSFEEDTEEDKPKYEQGGNIVDIDFDSVPQIQGQNNGDQSFEEDTEEDKPKYEQGGNIIDIDFDSVPHIHGFNKHTEIIEEDTNKDKPNYQFGGHSSVDFEEDTLPQVSGHNEGQQTIEEDTTPPIVPPTPPTPEVPSEPETPTPPTPEVPSEPETPTPPTPEVPSEPEVPTPPTPEIPSEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 38256 - protein, 985 aa, Staphylococcus aureus
  subsp. aureus CIGC93
MIVVGMGQDKEAAASEQKTTVEENGNSATDNKVSETQTTATNVNTIEETQSYNATVTEQPSNATQVTTEEAPNAVQEPQTAQPANVETVKEEEKPQVKETTQPQDNSGNQRQVDLTPKKVTQNQGTETQVEVAQPRTASESKPRVTRSADVVESKEASDAKVEMGTDVTSKVTVTESSIEGHNNTNKVEPHAGQRAVLKYKLKFEKGLHKGDYFDFTLSNNVNTHGVSTARKVPEIKNGSVVMATGKILEGGKIRYTFTNDIEDKVDVTAELEINLFIDPKTVQTNGNQTITSTLNGEQTSKELDVKYKDGIGNYYANLNGSIETFNKANNRFTHVAFIKPNNGKTTSVTVTGTLMKGSNQNGNQPKVRVFEYLGNNEDIAKSVYANTTDTSKFKEVTSSMNGNLNVQTNGSYSLNLENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEDSTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEHGGNIIDIDFDSVPHIHGFNKHTEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 38257 - protein, 913 aa, Staphylococcus aureus
  subsp. aureus CIGC93
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDKTGKNLKTQVIQENVDPATGKDYSIFGWNNENVVRYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSDSESDSDSDSDSESDSDSDSDSDSDSDSDSDSDSDSDSDSDSDSDSDSESDSDSDSDSDSDSDSDSDSDSDSDSDSDSDSDSDSDSDSDSDSESDSDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 38258 - protein, 1671 aa, Staphylococcus aureus
  subsp. aureus CIGC93
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTSSKNTTSSSDTKSVASTSSTEQPINISTNQSTASNNTSQSTTPSSANLNKTSTTSTSTAPVKLRTFSRLAMSTFASAATTTALTANTITVNKDNLKQYMTTSGNATYDQSTGVVTLTQDTTSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSNSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSAMSAKGYNYTSVDSSYASTYNDTNKTVKMTNAGQSVTYYFTDVKAPTVTVGNQTTEVGKTMNPVVLTTTDNGTGTVTNTVTGLPSGLSYDSATNSIIGTPTKIGQSTVTVVSTDQANNKSTTAFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVDSQSVSSSMSGSVSKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSISGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSNSESTSTSKSESVSTSLSTSTSTSLSDSTSLSTSISDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSMSRSTSQSGSVSTSASLSGSTSTSISESLSTSGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 38259 - protein, 233 aa, Staphylococcus aureus; identical to SEQ ID NO: 30428
  subsp. aureus CIGC93

SEQ ID NO: 38260 - protein, 681 aa, Staphylococcus aureus
  subsp. aureus CIGC93
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSLTKEAPSLNKSDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKVTDTKQA

SEQ ID NO: 38261 - protein, 516 aa, Staphylococcus aureus
  subsp. aureus CIGC93
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNKKPGKEDNKKPGKEDNNKPGKEDNNKPGKEDGNKPGKEDNKKPGKEDNNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38262 - protein, 241 aa, Staphylococcus aureus
  subsp. aureus CIGC93
MKKLATVGSLIVTSTLVFSSMPFQNAHADTTSMNVSNKQSQNVQNHRPYGGVVPQGMTQAQYTELEKALPQLSADSNMQDYNMKLYDATQNIADKYNVIITTNVGVFKPHAVRDMNGHALPLTKDGNFYQTNVDANGINHGGSEMVQNKTGHMSQQGHMNQNTHMNQQPQIQQGHMQSSNHQMMSPKANMHSSNHQMNQSNKKVLPAAGESMTSSILTASIAALLLVSGLFLAFRRRSTNK

SEQ ID NO: 38263 - protein, 691 aa, Staphylococcus aureus
  subsp. aureus CIGC93
MLRGQEERKYSIRKYSIGVVSVLAATMFVVSSHEAQASEKTPTSNAAAQKETLNQPGEQGNVITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPDKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 38264 - protein, 203 aa, Staphylococcus aureus
  subsp. aureus CIGC93
MFKKYDSKNSIVLKSILSLGIIYGGTFGIYPNADASTQNSPSVQDKQFQKVEEVPNNSEKALVKKLYDRYSKGTINGKSNKSRNWVYSERPLNENQVRIHLEGTYRVADRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 38265 - protein, 226 aa, Staphylococcus aureus
  subsp. aureus CIGC93
MKFKAIAKASLALGMLATGVITSNVQSVQAKTEVKQQSEADLKLYYSGPSFEHKKVTGFKYTDEKGSFFEFIDRGQFNKVSLVGPDKDKLNDGDNSGLDVFVVREGYGRQADNHSIGGVTKTNRQSYFDQINTPILEIKNDSEDLYKGYHLIFKEDISLKELDYRLRERAIKQYGLYSNGLKQGQITITMNDGTTHTIDLSQKLEKERMGESIDGRQIQKILVEIK

SEQ ID NO: 38266 - protein, 231 aa, Staphylococcus aureus
  subsp. aureus CIGC93
MKMKSIAKISLLLGILATGVSTTTEKPVHAEKKPIVISENSKKLKAYYTQPSIEYKNVTGYISFIQPSIKFMNIIDGNSVNNLALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 38267 - protein, 356 aa, Staphylococcus aureus; identical to SEQ ID NO: 30793
  subsp. aureus CIGC93

SEQ ID NO: 38268 - protein, 281 aa, Staphylococcus aureus
  subsp. aureus CIGC93
MKITTIAKTSLALGLLTTGVITTTTQEANATTPSSTKVEAPQQAANATTPSSTKVEAPQQAANATTPPSSNVDTSPPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIENHNLYGNVGSGKIVIKMKNGGKYTFELHKKLQENRMADVIDGTNIDNIEVNIK

SEQ ID NO: 38269 - protein, 234 aa, Staphylococcus aureus; identical to SEQ ID NO: 33390
  subsp. aureus CIGC93

SEQ ID NO: 38270 - protein, 231 aa, Staphylococcus aureus
  subsp. aureus CIGC93
MKLKTIAKATLALGLLATGVITTESQTVKAAESTQGQHNYKSLKYYYSKPSIELKNLDGLYRQKVTDKGVYVWKDRKDYFVGLLGKDIEKYPQGEHDKQDAFLVIEEETVNGRQYSIGGLSKTNSKEFSKEVDVKVTRKIDESSEKSKDSKFKITKEEISLKELDFKLRKKLMEEEKLYGAVNNRKGKIVVKMEDDKFYTFELTKKLQPHRMGDTIDGTKIKEINVELEYK

SEQ ID NO: 38271 - protein, 231 aa, Staphylococcus aureus; identical to SEQ ID NO: 35425
  subsp. aureus CIGC93

SEQ ID NO: 38272 - protein, 232 aa, Staphylococcus aureus; identical to SEQ ID NO: 35426
  subsp. aureus CIGC93

SEQ ID NO: 38273 - protein, 232 aa, Staphylococcus aureus
  subsp. aureus CIGC93
MKLTALAKATLALGILTTGVFTAESKAVHAKVELDETQRKYYINMLHQYYSEESFEPTNISVKSEDYYGSNVLNFNQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFERMFDVMDSKKIKNIEVNLN

SEQ ID NO: 38274 - protein, 227 aa, Staphylococcus aureus
  subsp. aureus CIGC93
MKLTAIAKAALALGILTTGTLTTEVHSGHAKQNQKSVNKHDKEALYRYYTGKTMEMKNISALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKEKITLKELDFKLRKHLIEKYGLYKTISKDGRVKISLKDGSFYNLDLRSKLKFKYMGEVIESKQIKDIEVNLK

SEQ ID NO: 38275 - protein, 233 aa, Staphylococcus aureus
  subsp. aureus CIGC93
MKLKNIAKASLALGILTTGMITTTAQPVKADETSSRLSVTSKDTQELKGYYSGTGFNFQNVSGYREENKMNVIVGQQLNVISLLGSDKETFKDYDYDYEGLDVFVVREGSGKQAENISIGGITKTNKNDYKDFVNNVGLEITKPTGHNTATRQAETYRINKEEISLKELDFKLRKHLIDKHELYKTEPKDGKIRITMKGGGYYTFELNKKLQPHRMGDVIDGRNIEKIEVDLY

SEQ ID NO: 38276 - protein, 992 aa, Staphylococcus aureus
  subsp. aureus CIGC93
MNNKKTATNRKGMISNRLNKFSIRKYSVGTASILVGTTLIFGLSGHEAKAAEHTNGELNQSKNETTAPSENKTTEKVDSRQLKDNTQTADQPKVTMSDSATVKETSSNMQSPQNTTANQSTTQTSNVTTNDKSATTYSNDTSKSNLTQAKDVSTKPKTTTIKPRTLNRMAVNTVAAPQQGTNVNDKVHFKNIDIAIDKGHVNKDTGKTEFWATSSDVLKLKANYTIDDSVKEGDTFTFKYGQYFRPGSVRLPSKTQNLYNAQGNIIAKGIYDSATNSTTYTFTNYVDQYTNISGSIEQVSFAKRENATTDKTAYKMEVTLGNDSYSKEVIVDYGNKKAQPLISSTNYINNEDLSRNMTAYVNQPKNTYTKQTFVTNLTGYKFNPNAKNFKIYEVTNQNQFVDSFTPDTSKLTDVTDQFDINYSNDNKTATVDLMKGQKSSNKQYIIQQVAYPDNSSTDNGKIDYTLDTDKTKYSWSNSYSNVNGSSTANGDQKYNLGDYVWEDTNKDGKQDANEKGIKGVYVILKDSNGKELDRTTTDENGKYQFTGLSNGTYSVEFSTPAGYTPTTANAGTDDAIDSDGLTTTGVIKDADNMTLDSGFYKTPKYSLGDYVWYDSNKDGKQDSTEKGIKGVKVTLQNEKGEVIGTTETDSNGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDGDSDSDSDSDSDSDSDSDSDSDSDSDSDSDSDSDSDSDSDSDAGKHIPAKPMSTVKDHHNKAKALPETGSENNNSNNGTLFGGLFAALGSLLLFGRRKKQNK

SEQ ID NO: 38277 - protein, 1399 aa, Staphylococcus aureus
  subsp. aureus CIGC93
MLNRENKTAITRKGMVSNRLNKFSIRKYTVGTASILVGTTLIFGLGNQEAKAAESTNKELNEATTSASDNQSSGKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVVFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 38278 - protein, 1071 aa, Staphylococcus aureus
  subsp. aureus CIGC93
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTNHSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 38279 - protein, 434 aa, Staphylococcus aureus [sequence omitted]

SEQ ID NO: 38280 - protein, 890 aa, Staphylococcus aureus
  subsp. aureus CIGC93
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQNTDASNKDVVNQAVNTSAPRKRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSGSDSNSDSGSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDNDSDSDSDSESDSDSDSDSDSDSASDSDSGSDSDSDSDSDSDSDSDSDSESDSDSDSDSDSDSDSDSDSDSDSDLDSDSDSDSGSDSESDSDSDSESDSNSDSESGSNNNVVPPNSPKNGTNASNKNEAKDSKEPLPDTGSEDEANTSLIWGLLASLGSLLLFRRKKENKDKK

SEQ ID NO: 38281 - protein, 644 aa, Staphylococcus aureus; identical to SEQ ID NO: 34015
  subsp. aureus CIGC93

SEQ ID NO: 38282 - protein, 350 aa, Staphylococcus aureus
  subsp. aureus CIGC93
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPAVTAPSKAEDNHSTKVVSTETTKDQTKTQTAHTVKTAQTAQEQNKVQTPVKDVATAKSESNNQAVSDNKSQQTNKVTKQNETPKQASKAKELPKTGLTSVDNFISTVAFATLALLGSLSLLLFKRKESK

SEQ ID NO: 38283 - protein, 105 aa, Staphylococcus aureus; identical to SEQ ID NO: 33600
  subsp. aureus CIGC93

SEQ ID NO: 38284 - protein, 165 aa, Staphylococcus aureus; identical to SEQ ID NO: 30418
  subsp. aureus CIGC93

SEQ ID NO: 38285 - protein, 319 aa, Staphylococcus aureus; identical to SEQ ID NO: 30605
  subsp. aureus CIGC93

SEQ ID NO: 38286 - protein, 238 aa, Staphylococcus aureus; identical to SEQ ID NO: 30740
  subsp. aureus CIGC93

SEQ ID NO: 38287 - protein, 241 aa, Staphylococcus aureus
  subsp. aureus CIGC93
MNNNITKKIILSTTLLLLGTAFTQFPNTPINSSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNNKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 38288 - protein, 250 aa, Staphylococcus aureus
  subsp. aureus CIGC93
MKKNIMNKLVLSTALLLLGTTSTQLPKTPISFSSEAKAYNISENETNINELIKYYTQPHLSLSNKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITVDGNNYTIDLSKKLKLTDTNRYVKNPKNAQIEVILEKSNQPITFCKCG

SEQ ID NO: 38289 - protein, 372 aa, Staphylococcus aureus; identical to SEQ ID NO: 30609
  subsp. aureus CIGC93

SEQ ID NO: 38290 - protein, 1329 aa, Staphylococcus aureus
  subsp. aureus CIGC93
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSTVNQATPTSVQSSTPSAQNNNHTDGNTTATETVLNANNNDVVSNNTTLNVPNKTNENGSGGHLTLKEIQEDVRHSSDKPELVAIAEPASNRPKKRSRRAAPADPNATPADPAAAAAGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRILGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVYVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSPAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKNKQREIKSLLKWRSVLKRLNKHLMQLTKKSRLLLIKSINLKIKQLIKLIKTKQMIR

SEQ ID NO: 38291 - protein, 331 aa, Staphylococcus aureus; identical to SEQ ID NO: 34042
  subsp. aureus CIGC93

SEQ ID NO: 38292 - protein, 234 aa, Staphylococcus aureus
  subsp. aureus CIGC93
MLEEILTNSASAIEYSDLHHKSKFDSKRLSNAKMSFINPTQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQAEIELTAVKTKKKIVTIQELDVQLRNYLNEKYKLYEQGGDIVKGYVKYHNDDEQNIEYNFYNLNGEYGYEILKMYADNKTINSDKLHLDIYLFKS

SEQ ID NO: 38293 - protein, 291 aa, Staphylococcus aureus; identical to SEQ ID NO: 30390
  subsp. aureus CIGC93

SEQ ID NO: 38294 - protein, 895 aa, Staphylococcus aureus
  subsp. aureus CIGC93
MNNHHPKLRSFYSIRKSTLGVASVIVSTLFLITSQHQAQAAENTNTSDKISENQNNNATTTQPPKDTNQTQPATQPANTTKTYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSTINNANNQPQATTNMSQPAQPKLSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEDKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKITEHLPSDIHKTVDKTVKTKEKAGTPSKENKLSQSKMLPKTGETTSSQSWWGLYALLGMLALFIPKFRKESK

SEQ ID NO: 38295 - protein, 807 aa, Staphylococcus aureus
  subsp. aureus CIGC93
MTYKMKKWQKLSTITLLMAGVITLNGGEFRSIDKHQIAVADTNVQTPDYEKLRNTWLDVNYGYDKYDENNPDMKKKFDATEKEAEKLLKEMKTESDRKYLWENSKDLDTKSADMTRTYRNIEKIAEAMKHKDTKLKTDENKKKVKDALDWLHENAYGKEPDKKVKELTENFKITDSSKKKALNWWDYEIGTPRALTNTLILLNGDISSDEKKKYTAPIKTFAPDSDKILSSVGKPEQAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDESTKAKYKQIVKTSVKSDSSYKQNDYLSSYSDISKMKSLIEDSTISTNGLTQQLKIYNDMDRVTYHNKELDFAFGLSMTSKNVARYESINGENLKGWHTGAGMSYLYNSDVKHYRDNFWATADMTRLPGTTTLNDMPSTNTKNDNSFVGGTKFDEQHASIGMDFENQDKTLTAKKSYFILNDKIVFLGTGIKSTGSSENPITTIENRKANEYKLYKDDIENTTSNDNTQETHSVFLESSDTKKNIGYHFLDKPKISVKKETHIGKWKDINNSQSNTQKNDDYYEVTQTHNTSDSKYAYVLYPGLTKSDFKSKNNIVNIIKQDEDFHVIKDNDGIFAGVNYSDSTKTFDINGTKVEVKAKGMFVIKKKDDKTYECSFYNPETTNTASNIESKISIAGYTLINKSVTNSNEAGVNFELTK

SEQ ID NO: 38296 - protein, 327 aa, Staphylococcus aureus; identical to SEQ ID NO: 30616
  subsp. aureus CIGC93

SEQ ID NO: 38297 - protein, 311 aa, Staphylococcus aureus; identical to SEQ ID NO: 30617
  subsp. aureus CIGC93

SEQ ID NO: 38298 - protein, 96 aa, Staphylococcus aureus; identical to SEQ ID NO: 30813
  subsp. aureus CIGC93

SEQ ID NO: 38299 - protein, 231 aa, Staphylococcus aureus; identical to SEQ ID NO: 33380
  subsp. aureus CIGC93

SEQ ID NO: 38300 - protein, 338 aa, Staphylococcus aureus; identical to SEQ ID NO: 30627
  subsp. aureus CIGC93

SEQ ID NO: 38301 - protein, 351 aa, Staphylococcus aureus; identical to SEQ ID NO: 30628
  subsp. aureus CIGC93

SEQ ID NO: 38302 - protein, 44 aa, Staphylococcus aureus; identical to SEQ ID NO: 30513
  subsp. aureus CIGC93

SEQ ID NO: 38303 - protein, 231 aa, Staphylococcus aureus; identical to SEQ ID NO: 33623
  subsp. aureus CIGC93

SEQ ID NO: 38304 - protein, 2446 aa, Staphylococcus aureus
  subsp. aureus CIGC93
MNLFRQQKFSIRKFNVGIFSALIATVTFISTNPTTASAAEQNQPAQNQPAQPADANTQPNANAGAQANPAAQPANQGGQANPAGGAAQPNTQPAGQGNQADPNNAAQAQPGNQATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVEAAQKQGLHDIQVVKSKQEVADTKSKVLDKINAIQTQAKVKPAADTEVENAYNTRKQEIQNSNASTTEEKQAAYTELDAKKQEARTNLDAANTNSDVTTAKDNGIAAINQVQAATTKKSDAKAEIAQKASERKTAIEAMNDSTTEEQQAAKDKVDQVVVTANADIDNAAANADVDNAKTTNEATIAAITPDANVKPTAKQAIADKVQAQETAIDANNGATTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQAIQATPDATNEEKQAADAEANTENGKAIQAIAAATTNADVDEAKANAEAAINAVTPKVVKKQAAKDEIDQLQATQTNVINNDQNATNEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTADVTTAKDTAVQKVQQLHANPVKKPAGKKELDQAAADKKTQIEQTPNASQQEINDAKQEIDTELNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPKVESTNNGTTDKPVTETDNATPAESTTNNNSTTTATNENAPTGSTTTAPTTASTEAASSADSKDNASVNDSKQNAEVNNSAESQSTNGKVAQPKSENKAKAEKDGRDSTNQSMVESTTETLPSADITEPNVPSNTSKDKEESTSNQTDAGQPKSETNVASNEADKSPSKADTEVSNKPSTSASSEAKDKMTSTNVSQKDDTATADTNDTQTSVGPDANNKAMQNGGANASSATVSNGSHSMHQDMLKVTNTDDHQAKTKSAQQGKVNKPKQQAKTLPDTGMSHNDDLPYAELALGAGMAFLIRRFTKKDQQTEE

SEQ ID NO: 38305 - protein, 807 aa, Staphylococcus aureus
  subsp. aureus CIGC93
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNIARYESINGENLKGWHTGAGMSYLYNSDVKHYRDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 38306 - protein, 141 aa, Staphylococcus aureus; identical to SEQ ID NO: 30715
  subsp. aureus CIGC93

SEQ ID NO: 38307 - protein, 309 aa, Staphylococcus aureus; identical to SEQ ID NO: 30406
  subsp. aureus CIGC93

SEQ ID NO: 38308 - protein, 315 aa, Staphylococcus aureus; identical to SEQ ID NO: 30573
  subsp. aureus CIGC93

SEQ ID NO: 38309 - protein, 325 aa, Staphylococcus aureus; identical to SEQ ID NO: 30407
  subsp. aureus CIGC93

SEQ ID NO: 38310 - protein, 543 aa, Staphylococcus aureus
  subsp. aureus CIGC93
LQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPDNPGLSKDRAKPNEPVHSMDKNDKVKKSKIAKKSVANQEKKRAELPKTGAESTQKGLIFSSIIGIAGLMLLARRRKN

SEQ ID NO: 38311 - protein, 2186 aa, Staphylococcus aureus
  subsp. aureus CM05
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQANIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 38312 - protein, 233 aa, Staphylococcus aureus; identical to SEQ ID NO: 30591
  subsp. aureus CM05

SEQ ID NO: 38313 - protein, 445 aa, Staphylococcus aureus
  subsp. aureus CM05
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKLKRFHSRKNVNLIR

SEQ ID NO: 38314 - protein, 860 aa, Staphylococcus aureus
  subsp. aureus CM05
MHLKGDIIVKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGISLISTSTVCHKFMDSISIMKLLKKIQTKINLIINSVDTIVLTLKKIHFQK

SEQ ID NO: 38315 - protein, 891 aa, Staphylococcus aureus
  subsp. aureus CM05
MNKHHPKLRSFYSIRKSTLGVASVIVSTLFLITSQHQAQAAENTNTSDKISENQNNNATTTQQPKDTNQTQPATQPVITVKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 38316 - protein, 729 aa, Staphylococcus aureus
  subsp. aureus CM05
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKD

SEQ ID NO: 38317 - protein, 74 aa, Staphylococcus aureus
  subsp. aureus CM05
SDSDSDSDSDSDSDAGKHTPVKPMSTTKDHHNKAKALPETGSENNGSNNATLFGGLFAALGSLLLFGRRKKQNK

SEQ ID NO: 38318 - protein, 2481 aa, Staphylococcus aureus; identical to SEQ ID NO: 31413
  subsp. aureus CM05

SEQ ID NO: 38319 - protein, 315 aa, Staphylococcus aureus
  subsp. aureus CM05
MLKNKILATTLSVSLLALLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 38320 - protein, 434 aa, Staphylococcus aureus [sequence omitted]

SEQ ID NO: 38321 - protein, 239 aa, Staphylococcus aureus; identical to SEQ ID NO: 32649
  subsp. aureus CM05

SEQ ID NO: 38322 - protein, 226 aa, Staphylococcus aureus; identical to SEQ ID NO: 30577
  subsp. aureus CM05

SEQ ID NO: 38323 - protein, 681 aa, Staphylococcus aureus; identical to SEQ ID NO: 30598
  subsp. aureus CM05

SEQ ID NO: 38324 - protein, 157 aa, Staphylococcus aureus; identical to SEQ ID NO: 30611
  subsp. aureus CM05

SEQ ID NO: 38325 - protein, 93 aa, Staphylococcus aureus
  subsp. aureus CM05
DSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 38326 - protein, 241 aa, Staphylococcus aureus
  subsp. aureus CM05
MNNNITKKIILSTTLLLLGTAFTQFPNTPINSSSEAKAYYINQNETNVNELTKYYSQKYLTFSNSTLWQKDNGTIHATLLQFSWYSHIQVYGPKSWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGTDNNYTIDLSKRLPSTDANRYVKKPQNAKIEVILEKSN

SEQ ID NO: 38327 - protein, 689 aa, Staphylococcus aureus
  subsp. aureus CM05
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGIQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDGNGKYRFDNLDSGKYKVIFEKPAGLTQTGTNTTEDDK

SEQ ID NO: 38328 - protein, 83 aa, Staphylococcus aureus
  subsp. aureus CM05
DSDSDSDSDSDSDSDSDSDSDSDAGKHTPTKPMSTVKDQHKTAKALPETGSENNNSNNGTLFGGLFAALGSLLLFGRRKKQNK

SEQ ID NO: 38329 - protein, 251 aa, Staphylococcus aureus; identical to SEQ ID NO: 30946
  subsp. aureus CM05

SEQ ID NO: 38330 - protein, 190 aa, Staphylococcus aureus
  subsp. aureus CM05
MKRILIIVVLLFCYSQNHIATADVGVLNLRNYYGSYPIEDHQSINPENNHLSHQLVFSMDNSTVTAEFKNVDDVKKFKNHAVDVYGLSYSGYCLKNKYIYGGVTLAGDYLEKSRRIPINLWVNGEHQTISTDKVSTNKKLVTAQEIDTKLRRYLQEEYNIYGFNDTNKGRNYGNKSKFSSGFNAGKYYFI

SEQ ID NO: 38331 - protein, 234 aa, Staphylococcus aureus; identical to SEQ ID NO: 32190
  subsp. aureus CM05

SEQ ID NO: 38332 - protein, 356 aa, Staphylococcus aureus; identical to SEQ ID NO: 30793
  subsp. aureus CM05

SEQ ID NO: 38333 - protein, 338 aa, Staphylococcus aureus; identical to SEQ ID NO: 30627
  subsp. aureus CM05

SEQ ID NO: 38334 - protein, 603 aa, Staphylococcus aureus
  subsp. aureus CM05
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDS

SEQ ID NO: 38335 - protein, 321 aa, Staphylococcus aureus; identical to SEQ ID NO: 30959
  subsp. aureus CM05

SEQ ID NO: 38336 - protein, 242 aa, Staphylococcus aureus; identical to SEQ ID NO: 30399
  subsp. aureus CM05

SEQ ID NO: 38337 - protein, 327 aa, Staphylococcus aureus; identical to SEQ ID NO: 30616
  subsp. aureus CM05

SEQ ID NO: 38338 - protein, 227 aa, Staphylococcus aureus; identical to SEQ ID NO: 30585
  subsp. aureus CM05

SEQ ID NO: 38339 - protein, 297 aa, Staphylococcus aureus; identical to SEQ ID NO: 32648
  subsp. aureus CM05

SEQ ID NO: 38340 - protein, 214 aa, Staphylococcus aureus; identical to SEQ ID NO: 30966
  subsp. aureus CM05

SEQ ID NO: 38341 - protein, 68 aa, Staphylococcus aureus; identical to SEQ ID NO: 32241
  subsp. aureus CM05

SEQ ID NO: 38342 - protein, 271 aa, Staphylococcus aureus
  subsp. aureus CM05
MELIKIIANTILTSLTFKFLIPRIMIPLKGDVLMSKNITKNIILTTTLLLLGTVLPQNQKPVFSFYSEAKAYSIGQDETNINELIKYYTQPHFSFSNKWLYQYDNENIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYTENRNKGKLKITGGGNNYTIDLSKRLHSDLANVYVKNPNKITVDVLFD

SEQ ID NO: 38343 - protein, 372 aa, Staphylococcus aureus; identical to SEQ ID NO: 30609
  subsp. aureus CM05

SEQ ID NO: 38344 - protein, 96 aa, Staphylococcus aureus; identical to SEQ ID NO: 30813
  subsp. aureus CM05

SEQ ID NO: 38345 - protein, 199 aa, Staphylococcus aureus
  subsp. aureus CM05
MPQIHGFNKHNEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 38346 - protein, 270 aa, Staphylococcus aureus; identical to SEQ ID NO: 35140
  subsp. aureus CM05

SEQ ID NO: 38347 - protein, 805 aa, Staphylococcus aureus
  subsp. aureus CM05
MKKWQKLSTITLLMAGVITLNGGEFRSIDKHQIAVADTNVQTPDYEKLRNTWLDVNYGYDKYDEKNDAMKKKFDATEKEAEKLLSSMKTESGRTYLWDSAKDLDNKSADMTRTYRNIEKIAEAMRHPKTTLNTDENKKKVKDALEWLHKNAYGKEPDNKVKELTENFKITDSSKKKALNWWDYEIGTPRSLTNTLILLNDQFSNEEKKKFTAPIKTFAPKSDEILSSVGKAEPAKGGNLVDIAKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDDSTKAKYKKIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSNSTQTFDINNTKVEVKAKGMFILKNKDDNTYECSFYNPESTNTASDIESKISITGYSITNKNTSTSNESGVHFELTK

SEQ ID NO: 38348 - protein, 71 aa, Staphylococcus aureus
  subsp. aureus CM05
DSDSDSDSDSDAGKHTPVKPMSTTKDHHNKAKALPETGNENSGSNNATLFGGLFAALGSLLLFGRRKKQNK

SEQ ID NO: 38349 - protein, 325 aa, Staphylococcus aureus; identical to SEQ ID NO: 30407
  subsp. aureus CM05

SEQ ID NO: 38350 - protein, 1020 aa, Staphylococcus aureus
  subsp. aureus CM05
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYV

SEQ ID NO: 38351 - protein, 127 aa, Staphylococcus aureus
  subsp. aureus CM05
MTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 38352 - protein, 254 aa, Staphylococcus aureus; identical to SEQ ID NO: 30809
  subsp. aureus CM05

SEQ ID NO: 38353 - protein, 231 aa, Staphylococcus aureus; identical to SEQ ID NO: 30582
  subsp. aureus CM05

SEQ ID NO: 38354 - protein, 231 aa, Staphylococcus aureus; identical to SEQ ID NO: 30578
  subsp. aureus CM05

SEQ ID NO: 38355 - protein, 203 aa, Staphylococcus aureus; identical to SEQ ID NO: 30576
  subsp. aureus CM05

SEQ ID NO: 38356 - protein, 141 aa, Staphylococcus aureus; identical to SEQ ID NO: 30633
  subsp. aureus CM05

SEQ ID NO: 38357 - protein, 257 aa, Staphylococcus aureus
  subsp. aureus CM05
EIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 38358 - protein, 241 aa, Staphylococcus aureus; identical to SEQ ID NO: 30608
  subsp. aureus CM05

SEQ ID NO: 38359 - protein, 322 aa, Staphylococcus aureus
  subsp. aureus CM05
MMKMKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKASKQQTNIDVIYERVRDDYQLHWTSTNWKGTNTKDKWTDRSSERYKIDWEKEEMTN

SEQ ID NO: 38360 - protein, 132 aa, Staphylococcus aureus
  subsp. aureus CM05
MNKNSKKKLDFLPNKLNKYSIRRFTVGTASILVGATLIFGVANDQAEAAENNTTQKQDDSSDASKVKGNVQTIEQSSANSNESDIPEQVDVTKDTTEQASTEEKADTTEQATTEEAPKAEGTDKVETEEAPK

SEQ ID NO: 38361 - protein, 274 aa, Staphylococcus aureus; identical to SEQ ID NO: 30872
  subsp. aureus CM05

SEQ ID NO: 38362 - protein, 231 aa, Staphylococcus aureus; identical to SEQ ID NO: 30630
  subsp. aureus CM05

SEQ ID NO: 38363 - protein, 63 aa, Staphylococcus aureus
  subsp. aureus CM05
DSDSDSDADRDHNDKTDKPNNKELPDTGNDAQNNGTLFGSLFAALGGLFLVGRRRKNKNNEEK

SEQ ID NO: 38364 - protein, 258 aa, Staphylococcus aureus; identical to SEQ ID NO: 30410
  subsp. aureus CM05

SEQ ID NO: 38365 - protein, 49 aa, Staphylococcus aureus
  subsp. aureus CM05
MNDGSSFSYDLFDTGTGQAESFLKIYNDNKTVETEKFHLDVEISYKDES

SEQ ID NO: 38366 - protein, 311 aa, Staphylococcus aureus; identical to SEQ ID NO: 30617
  subsp. aureus CM05

SEQ ID NO: 38367 - protein, 232 aa, Staphylococcus aureus; identical to SEQ ID NO: 30584
  subsp. aureus CM05

SEQ ID NO: 38368 - protein, 91 aa, Staphylococcus aureus
  subsp. aureus CM05
MSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 38369 - protein, 693 aa, Staphylococcus aureus
  subsp. aureus CM05
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSD

SEQ ID NO: 38370 - protein, 351 aa, Staphylococcus aureus; identical to SEQ ID NO: 30628
  subsp. aureus CM05

SEQ ID NO: 38371 - protein, 339 aa, Staphylococcus aureus
  subsp. aureus CM05
SDSASDSDSASDSDSASDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 38372 - protein, 365 aa, Staphylococcus aureus
  subsp. aureus CM05
MKITYKYRGDLPLNTENNKNQNQSVKNSERRGMLKGCGGCLISFILLIILLSACSMMFSNNDNSTSNQSSKTQLTQKDENKNEDKPEEKSETATDEDLQSTEEVPANENTENNQHEIDETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETATVEPMPQSKPTTSEAPPSQNNHNENNMYDASTE

SEQ ID NO: 38373 - protein, 350 aa, Staphylococcus aureus; identical to SEQ ID NO: 30602
  subsp. aureus CM05

SEQ ID NO: 38374 - protein, 236 aa, Staphylococcus aureus; identical to SEQ ID NO: 32523
  subsp. aureus CM05

SEQ ID NO: 38375 - protein, 227 aa, Staphylococcus aureus; identical to SEQ ID NO: 30586
  subsp. aureus CM05

SEQ ID NO: 38376 - protein, 165 aa, Staphylococcus aureus; identical to SEQ ID NO: 30418
  subsp. aureus CM05

SEQ ID NO: 38377 - protein, 109 aa, Staphylococcus aureus; identical to SEQ ID NO: 30603
  subsp. aureus CM05

SEQ ID NO: 38378 - protein, 645 aa, Staphylococcus aureus; identical to SEQ ID NO: 30601
  subsp. aureus CM05

SEQ ID NO: 38379 - protein, 691 aa, Staphylococcus aureus
  subsp. aureus CM05
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMSPNITYTTYTGVSSHTGPLGYENPDLGTFFLMDTTSRIIGHDAREEWRKNDGVVPVISSLHPSNQPFINVTNDEPATRRGIWQVKPIIQGWDHVDFIGVDFLDFKRKGAELANFYTGIINDLLRVEATESKGTQLKAS

SEQ ID NO: 38380 - protein, 243 aa, Staphylococcus aureus
  subsp. aureus CM05
IQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38381 - protein, 241 aa, Staphylococcus aureus; identical to SEQ ID NO: 30571
  subsp. aureus CM05

SEQ ID NO: 38382 - protein, 240 aa, Staphylococcus aureus
  subsp. aureus CO-23
DSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 38383 - protein, 242 aa, Staphylococcus aureus; identical to SEQ ID NO: 31992
  subsp. aureus CO-23

SEQ ID NO: 38384 - protein, 242 aa, Staphylococcus aureus; identical to SEQ ID NO: 31991
  subsp. aureus CO-23

SEQ ID NO: 38385 - protein, 352 aa, Staphylococcus aureus; identical to SEQ ID NO: 30767
  subsp. aureus CO-23

SEQ ID NO: 38386 - protein, 174 aa, Staphylococcus aureus
  subsp. aureus CO-23
MTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 38387 - protein, 226 aa, Staphylococcus aureus; identical to SEQ ID NO: 30769
  subsp. aureus CO-23

SEQ ID NO: 38388 - protein, 227 aa, Staphylococcus aureus; identical to SEQ ID NO: 30585
  subsp. aureus CO-23

SEQ ID NO: 38389 - protein, 68 aa, Staphylococcus aureus
  subsp. aureus CO-23
MKELDFKIRKLLIKKYKLYEGSADKGRIVINMKDENKYEIDLSDKLDFERMADVINSEQIKNIEVNLK

SEQ ID NO: 38390 - protein, 231 aa, Staphylococcus aureus; identical to SEQ ID NO: 30560
  subsp. aureus CO-23

SEQ ID NO: 38391 - protein, 232 aa, Staphylococcus aureus; identical to SEQ ID NO: 30765
  subsp. aureus CO-23

SEQ ID NO: 38392 - protein, 308 aa, Staphylococcus aureus; identical to SEQ ID NO: 31787
  subsp. aureus CO-23

SEQ ID NO: 38393 - protein, 231 aa, Staphylococcus aureus; identical to SEQ ID NO: 31761
  subsp. aureus CO-23

SEQ ID NO: 38394 - protein, 234 aa, Staphylococcus aureus; identical to SEQ ID NO: 31052
  subsp. aureus CO-23

SEQ ID NO: 38395 - protein, 434 aa, Staphylococcus aureus [sequence omitted]

SEQ ID NO: 38396 - protein, 702 aa, Staphylococcus aureus
  subsp. aureus CO-23
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSD

SEQ ID NO: 38397 - protein, 645 aa, Staphylococcus aureus; identical to SEQ ID NO: 30747
  subsp. aureus CO-23

SEQ ID NO: 38398 - protein, 109 aa, Staphylococcus aureus; identical to SEQ ID NO: 30744
  subsp. aureus CO-23

SEQ ID NO: 38399 - protein, 319 aa, Staphylococcus aureus; identical to SEQ ID NO: 30741
  subsp. aureus CO-23

SEQ ID NO: 38400 - protein, 241 aa, Staphylococcus aureus; identical to SEQ ID NO: 30739
  subsp. aureus CO-23

SEQ ID NO: 38401 - protein, 165 aa, Staphylococcus aureus; identical to SEQ ID NO: 30742
  subsp. aureus CO-23

SEQ ID NO: 38402 - protein, 350 aa, Staphylococcus aureus; identical to SEQ ID NO: 30602
  subsp. aureus CO-23

SEQ ID NO: 38403 - protein, 241 aa, Staphylococcus aureus; identical to SEQ ID NO: 30738
  subsp. aureus CO-23

SEQ ID NO: 38404 - protein, 238 aa, Staphylococcus aureus; identical to SEQ ID NO: 30740
  subsp. aureus CO-23

SEQ ID NO: 38405 - protein, 183 aa, Staphylococcus aureus
  subsp. aureus CO-23
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 38406 - protein, 325 aa, Staphylococcus aureus; identical to SEQ ID NO: 30484
  subsp. aureus CO-23

SEQ ID NO: 38407 - protein, 312 aa, Staphylococcus aureus; identical to SEQ ID NO: 30196
  subsp. aureus CO-23

SEQ ID NO: 38408 - protein, 404 aa, Staphylococcus aureus
  subsp. aureus CO-23
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDIFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPKCKKLQNLRSDRSKSICG

SEQ ID NO: 38409 - protein, 231 aa, Staphylococcus aureus; identical to SEQ ID NO: 31073
  subsp. aureus CO-23

SEQ ID NO: 38410 - protein, 690 aa, Staphylococcus aureus; identical to SEQ ID NO: 31973
  subsp. aureus CO-23

SEQ ID NO: 38411 - protein, 203 aa, Staphylococcus aureus; identical to SEQ ID NO: 30770
  subsp. aureus CO-23

SEQ ID NO: 38412 - protein, 321 aa, Staphylococcus aureus; identical to SEQ ID NO: 30959
  subsp. aureus CO-23

SEQ ID NO: 38413 - protein, 315 aa, Staphylococcus aureus; identical to SEQ ID NO: 30440
  subsp. aureus CO-23

SEQ ID NO: 38414 - protein, 325 aa, Staphylococcus aureus; identical to SEQ ID NO: 30407
  subsp. aureus CO-23

SEQ ID NO: 38415 - protein, 1329 aa, Staphylococcus aureus
  subsp. aureus CO-23
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKNKQREIKSLLKWRSVLKRLNKHLMQLTKKSRLLLIKSINLKIKQLIKLIKTKQMIR

SEQ ID NO: 38416 - protein, 130 aa, Staphylococcus aureus
  subsp. aureus CO-23
SDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 38417 - protein, 143 aa, Staphylococcus aureus
  subsp. aureus CO-23
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKKVYNLPLEIKLKFQLPNQMSKLHQNLRMKI

SEQ ID NO: 38418 - protein, 639 aa, Staphylococcus aureus
  subsp. aureus CO-23
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKLRKMKLQHL

SEQ ID NO: 38419 - protein, 657 aa, Staphylococcus aureus
  subsp. aureus CO-23
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKKVILVSGKK

SEQ ID NO: 38420 - protein, 141 aa, Staphylococcus aureus; identical to SEQ ID NO: 30715
  subsp. aureus CO-23

SEQ ID NO: 38421 - protein, 119 aa, Staphylococcus aureus
  subsp. aureus CO-23
MYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 38422 - protein, 1024 aa, Staphylococcus aureus
  subsp. aureus CO-23
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSD

SEQ ID NO: 38423 - protein, 158 aa, Staphylococcus aureus
  subsp. aureus CO-23
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 38424 - protein, 372 aa, Staphylococcus aureus; identical to SEQ ID NO: 31084
  subsp. aureus CO-23

SEQ ID NO: 38425 - protein, 233 aa, Staphylococcus aureus; identical to SEQ ID NO: 30428
  subsp. aureus CO-23

SEQ ID NO: 38426 - protein, 274 aa, Staphylococcus aureus; identical to SEQ ID NO: 30872
  subsp. aureus CO-23

SEQ ID NO: 38427 - protein, 351 aa, Staphylococcus aureus; identical to SEQ ID NO: 30720
  subsp. aureus CO-23

SEQ ID NO: 38428 - protein, 338 aa, Staphylococcus aureus; identical to SEQ ID NO: 30699
  subsp. aureus CO-23

SEQ ID NO: 38429 - protein, 225 aa, Staphylococcus aureus; identical to SEQ ID NO: 30763
  subsp. aureus CO-23

SEQ ID NO: 38430 - protein, 895 aa, Staphylococcus aureus; identical to SEQ ID NO: 30734
  subsp. aureus CO-23

SEQ ID NO: 38431 - protein, 113 aa, Staphylococcus aureus
  subsp. aureus CO-23
DSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 38432 - protein, 327 aa, Staphylococcus aureus; identical to SEQ ID NO: 30538
  subsp. aureus CO-23

SEQ ID NO: 38433 - protein, 311 aa, Staphylococcus aureus; identical to SEQ ID NO: 30617
  subsp. aureus CO-23

SEQ ID NO: 38434 - protein, 290 aa, Staphylococcus aureus
  subsp. aureus CO-23
EQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38435 - protein, 995 aa, Staphylococcus aureus; identical to SEQ ID NO: 31038
  subsp. aureus CO-23

SEQ ID NO: 38436 - protein, 917 aa, Staphylococcus aureus; identical to SEQ ID NO: 31037
  subsp. aureus CO-23

SEQ ID NO: 38437 - protein, 444 aa, Staphylococcus aureus; identical to SEQ ID NO: 32034
  subsp. aureus CO-23

SEQ ID NO: 38438 - protein, 331 aa, Staphylococcus aureus; identical to SEQ ID NO: 30732
  subsp. aureus CO-23

SEQ ID NO: 38439 - protein, 681 aa, Staphylococcus aureus
  subsp. aureus CO-23
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISLLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 38440 - protein, 837 aa, Staphylococcus aureus
  subsp. aureus CO-23
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 38441 - protein, 2271 aa, Staphylococcus aureus; identical to SEQ ID NO: 32024
  subsp. aureus CO-23

SEQ ID NO: 38442 - protein, 366 aa, Staphylococcus aureus
  subsp. aureus CO-23
LTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 38443 - protein, 250 aa, Staphylococcus aureus; identical to SEQ ID NO: 31910
  subsp. aureus CO-23

SEQ ID NO: 38444 - protein, 291 aa, Staphylococcus aureus; identical to SEQ ID NO: 30390
  subsp. aureus CO-23

SEQ ID NO: 38445 - protein, 203 aa, Staphylococcus aureus
  subsp. aureus CO-23
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKK

SEQ ID NO: 38446 - protein, 241 aa, Staphylococcus aureus; identical to SEQ ID NO: 30776
  subsp. aureus CO-23

SEQ ID NO: 38447 - protein, 495 aa, Staphylococcus aureus
  subsp. aureus D139
MMTLQIHTGGINLKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNKPGKEDNKKPGKEDGNKPGKEDNNKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38448 - protein, 691 aa, Staphylococcus aureus
  subsp. aureus D139
MLRGQEERKYSIRKYSIGVVSVLAATMFIVSSHEAQASEKTLTSNAAAQKETLNQPGEQGNAITSHQMQSGKQLDDMHKENGKSGTVTEGKDTLQSSKHQSTQNSKTIRTQNDNQVKQDSERQGSKQSHQNNATNKTERQNDQVQNTHHAERNGSQSTTSQSNDVDKSQPSIPAQKVIPNHDNAAPTSTTPPSNDKTAPKSTKAQDATTDKHLNQQVTHQPAHQIIDAKQDDTVRQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 38449 - protein, 202 aa, Staphylococcus aureus
  subsp. aureus D139
MYKRLFISHVILIFALILVISTPNVLAESQPDPKPDELHKSSKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNQLDKYRSITVRVFEDGKNLLSFDVQTNKKKVTAQELDYLTRHYLVKNKKTL

SEQ ID NO: 38450 - protein, 203 aa, Staphylococcus aureus
  subsp. aureus D139
MFKKYDSKNSIVLKSILSLGIIYGGTFGIYPKADASTQNSSSVQDKQFQKVEEVPNNSEKALVKKLYDRYSQNTINGKSNKSRNWVYSERPLNENQVRIHLEGTYTVADRVYTPKRNITLNKEVITLKELDHIIRFAHISYGLYMGEHLPKGNIVINTKNGGKYTLESHKELQKDRENVKINTDDIKNVTFELVKSVNDIEQV

SEQ ID NO: 38451 - protein, 226 aa, Staphylococcus aureus
  subsp. aureus D139
MKFKAIAKASLALGMLATGVITSNTQSVQAKTEVKQQSEADLKLYYSGPSFEYKKVTGYGFIEGKDRFIDFIYNGQYNKISLVGSDKDKYNEEVNPDIDVFVVREGNGRQADNHSIGGVTKTNRQSYFDQINTPILEIKNGSEDLYKGYHLIFKENISLKELDYRLRERAIKQHGLYSNGLKQGQITITMNDGTTHTIDLSQKLEKERMGESIDGRQIQKILVEMK

SEQ ID NO: 38452 - protein, 231 aa, Staphylococcus aureus
  subsp. aureus D139
MKSIAKVSLVLGILATGVNTVTEQPVHAENKSIQVSQNSKNLKAYYTQPSVEYKNVTGYISSIQPKPGTKFMNIIEGNTVNNLALVGKDKQHYHTGVHRNLNIFYVNEDKRFEGAKYSIGGITEASDKAVDQIAEARVIKEDHTGEYAYDFFPFKIDKEAMTLKEVDFKIRKHLIDHYGLYGEMSTGTVTVKMKYYGKYTFELDKKLQEDRMADIIKVTDIDRIEVKVKKA

SEQ ID NO: 38453 - protein, 343 aa, Staphylococcus aureus
  subsp. aureus D139
MKIRTIAKASLALGLITTGASIVTTQAAKAEVTPSLKAERLAKISVSPSAITTTTQGANVEQNRTANPEQAPKSNTENVSTSPSTKTEQTPKSNIQKATQPTPSGTTQSLPNAQPQSPQPTPSVTTPPSSNVETQKPQSSTTKQAHKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSITKKDEKGKILHDVSEYKITKEEISLKELDFKLRKQLIEQHNLYGNIGSGTIVIKTKNGGKYTFELHKKLQEHRMADAIDGTSIDRIEVNLTSS

SEQ ID NO: 38454 - protein, 234 aa, Staphylococcus aureus
  subsp. aureus D139
MKMTAIAKASLALSILVTGVITSTAQTVNASEHEAKYENVTKDIFDLRDYYSRASKELKNVTGYRYSKGGKHYLIFDKNRKFTRIQIFGKDIERLKTRKNPGLDIFVVKESENRNGTVFSYGGVTKKNKGAYYDYLNAPRFVIKKEVGAGVYTHVKRHYIYKEEISLKELDFKLRQYLIQDFDLYKKFPKDSKIKVTMKDGGYYTFELNKKLQTNRMSDVIDGRNIEKIEANIR

SEQ ID NO: 38455 - protein, 231 aa, Staphylococcus aureus
  subsp. aureus D139
MKLKTLAKATLALGLLTTGVITSEGQAVKAAEKQERVQHLYDIKDLHRYYSSESIEYSNVSGKVENYNGSNVVRFNQKDQNHQLFLLGKDKDKYKEGLQGQNVFVVQELIDPNGRLSTVGGVTKNNNKTSETKTHLVVNKVDGGNLDASIDSFLIQKEEISLKELDFKIRQQLVNNYGLYKGTSKYGKIIINLKDEKREVIDLSDKLEFERMGDVLNSKDIRGIAVTINQI

SEQ ID NO: 38456 - protein, 232 aa, Staphylococcus aureus
  subsp. aureus D139
MKLTAIAKATLALGILTTGVMTAESQTVNAKVKLDETQRQYYIYMLKDYYSQESYESTNISVKSEDYYGSNVLNFNQRNKNFKVFLIGDDRNKYKELTHGLDVFAVPELIDTKGGIYSVGGITKKNVRSVFGYVSHPGLLVKKIDPKHGFSINELFFIQKEEVSLKELDFKIRKMLVEKYRLYKGASDKGRIVINMKDERKHEIDLSEKLSFDRMFDVIDSKQIKNIEVNLN

SEQ ID NO: 38457 - protein, 227 aa, Staphylococcus aureus
  subsp. aureus D139
MKFTALAKATLAIGILTTGTLTTEAHSGHAKQIQKSVNKHDKEALHRYYTGNFKEMKNINALRHGKNNLRFKYRGMKTQVLLPGDEYRKYQQRRHTGLDVFFVQERRDKHDISYTVGGVTKTNKTSGFVSTPRLNVTKENGEDAFVKGYPYDIKKEEISLKELDFKLRKYLIEKYGLYKTISKDGRIKISLKDGSFYNLDLRTKLKFKHMGEAIDSKQIKDIEVNLK

SEQ ID NO: 38458 - protein, 230 aa, Staphylococcus aureus
  subsp. aureus D139
MKLKNIAKASLALGILTTGMITTTAQPVKASESSSLSIITKNTKDLKDYYNGPTFSHKNISGYKEEDKVIFTPNMQQVSVKLTGKENLEFNDEDVVSNVDVFVVRENSDKSGNTLSIGGITKTNSQDNIDNVKSVNMQITKKISSNAETVTSSYYSINKEEISLKELDFKLRKQLIDKHDLYKTEPKDSKIKVTMKNGGYYTFELNKKLQPHRMGDVIDGRNIEKIEVNL

SEQ ID NO: 38459 - protein, 573 aa, Staphylococcus aureus
  subsp. aureus D139
MNNKKTATNRKGMIPNRLNKFSIRKYSVGTASILVGTTLIFGLSGHEAKAAEHTNGELNQSKNETTAPSENKTTEKVDSHQQNNIEQSTTSNQPKVNESDNTSVKETTEEPQNTTSTQPTKQNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNATTYTFTNYVDQYTNVSGSFEQVAFAKRENATTDKTAYKMEVTLGNDTYSEEVIVDYGNKKAQPLISSTNYINNEDLSRNMTVYVNQPKNTYTKETFVSNLTGYKFNPNAKNFKIYEVTDQNQFVDSFTPDTSKLIDVTDKFKITYSNDNKTATVDLLNGQSSSNKQYIIQQVAYPDNSSTDNGKIDYTLETQNGKSSWSNSYSSVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSD

SEQ ID NO: 38460 - protein, 137 aa, Staphylococcus aureus; identical to SEQ ID NO: 33685
  subsp. aureus D139

SEQ ID NO: 38461 - protein, 54 aa, Staphylococcus aureus; identical to SEQ ID NO: 35777
  subsp. aureus D139

SEQ ID NO: 38462 - protein, 434 aa, Staphylococcus aureus [sequence omitted]

SEQ ID NO: 38463 - protein, 945 aa, Staphylococcus aureus
  subsp. aureus D139
MNMKKKEKHAIRKKSIGVASVLVGTLIGFGLLSSKEADASENSVTQSDSASNESKSNNPSSVNAAPKTDNTNVSDTKTTSNTNNSETSVAQNPAQQETTQSASTNATTEETPVTGEGTTTATNQANTPAATQSNNTNAEELVNQTSNETTSNDTNTVSSVNSPQNSTNAENVSTTQDTSTEATPSNNESAPQSTDASNKDVVSQAVNPSAPRMRAFSLAAVAADAPAAGTDITNQLTDVTVGIESGDTVYPHQAGYVKLNYGFSVPNSAVKGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQVDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSDSASDSDSASDSDSTSDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSGSDSDSDSDSESDSDSDSDSDSDSASDSDSGSASDSDSDSDSASDSDSGSDSDSASDSDSDSDSDSDSDSDSDSDSDSDSDSDSDSDSDSDSDSDSDSDSDSASDSDSDSTSDTGSDNDSDSDSNSDFESGSNNNVVPPNSPKNGTNASNKNEAKDSKEPLPDTGSEGEANMSLIWGLLASLGSLLLFRRKKENKDKK

SEQ ID NO: 38464 - protein, 641 aa, Staphylococcus aureus
  subsp. aureus D139
MNKQQKEFKSFYSIRKSSLGVASVAISTLLLLMSNGEAKAAEETGGTNTEAQPKTEAVASPTTTTEKAPEAKPVANAVSVSNKEVVAPTTETKEAKEVKAPKETKEVKPAAKSDNNTYPILNEELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKTNKKEQQDNSAKKETTPATPSKPTTPPVEKESQKQDSQKDDNKQSASVEKENDASSESAKDKTPATKPAKAEVESSSITPTKVVSTTQNVAKPTTASSETTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 38465 - protein, 350 aa, Staphylococcus aureus
  subsp. aureus D139
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPAVTAPSKAENTQTTKVVSTEATKDQSQTQSARTVKTTQTAQEQNKVQTPVKDVTTAKSESNNQAVSENKSQQTNKVTKQNETPKQASKAKELPKTGLTSVDNFISTVAFATLALLGSLSLLLFKRKESK

SEQ ID NO: 38466 - protein, 105 aa, Staphylococcus aureus; identical to SEQ ID NO: 31168
  subsp. aureus D139

SEQ ID NO: 38467 - protein, 165 aa, Staphylococcus aureus
  subsp. aureus D139
MKNKLIAKSLLAIAAIGITTTTLASTADASEGYGPREKKPISINNNIVEYNDGTFKYQSRPKFNTTPKYIKFRHDYNIVEYNDGTFGYGPRPHFNKPAEKSVGTLKKEQKLIQAQNLVREFEKTHTVSAHRKAQKAVNLVSFEYNVKKMILQERIDQVLKQGLVR

SEQ ID NO: 38468 - protein, 319 aa, Staphylococcus aureus
  subsp. aureus D139
MKTRIVSSVTTTLLLGSVLLNPIANAADSDINIKPGTTDIGSNTTVKTGDLVTYDKENGMHKKIFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMMNQNWGPYDRDSWNPVYGNQLFMKTRNGSMKAAENFLDPNKASSLLSSGFSPDFATVITMDRKASKQQTNIDVIYERVRDDYQLHWTSTNWKGTNTKDKWTDRSSERYKIDWEKEEMTN

SEQ ID NO: 38469 - protein, 238 aa, Staphylococcus aureus
  subsp. aureus D139
MRKSITNKIILTTTLLLLGTTATQTPNSPLNVSTDAKAYYIDQDETNINELIKYYTQKPLTFSNRWLYQYDDGNIYVEFKRYSWSAHIRLWGAESWGNINQLRDRYVDVFGLKDEDTSQLWWVYRDTFTGGVTPAASSSDKPYSLFVQYKDKLQTIIGAHKMYQGNKPILTLKEIDFRAREALIKNKILYHENRNKGKLKITGGGNDYTIDLSKRLHSDLANVYVKNPQKITVEILID

SEQ ID NO: 38470 - protein, 241 aa, Staphylococcus aureus
  subsp. aureus D139
MEKNITKKIILSMALIIIGTATIQSPHSPISMSSNAKAYYIDQEETNVSELTKYYTQRHLTFSNKWLWQKENGTIHVTLLQLSWFSHIQVFGPESWGNINQLRNKYVDIFALKDYETWHTYMLAQETFTGGVTPAAKPSDKHYKLNLTYKDKSGTVIGGFPVYEGNKPVLTLKEVDFRIRQTLIKNKKLYHGDYNKGHIKITGGSNNYTIDLNKRLKSTDANRYVKNPQTAHIEILLEKSN

SEQ ID NO: 38471 - protein, 241 aa, Staphylococcus aureus
  subsp. aureus D139
MKKNIMNKLVLSTALLLLGTTSTQLPKTPISFSSEAKAYNISENETNINELIKYYTQPHLSLSGKWLWQKPNGTIHATLQTWVWYTHIQVFGPESWGNINQLRDKYVDIFGTKDEDTVEGYWTYDETFTGGVTPAATSSDKHYKLSLKYRDKLHTMIGGLEFYQGNKPVITLKELDFRVRQTLIKNKKLYNGEFNKGQIKITGGGNNYTIDLSKKLKLSDTNRYVKNPRNTEIEVILEKSR

SEQ ID NO: 38472 - protein, 234 aa, Staphylococcus aureus
  subsp. aureus D139
MLEGIFTNSASAIEYSDIHHKSKLNSKRLSNAKMSFINPTQLENKKTNDRLLTHDLLFHDMFLNDASKKDFKVEFENEALSNEFINKNIDIYAGSYSYECHGGETNKTQCSYGGVTLSDNNKYDNDKNIPCNLWIDGHQTEIELTAVKTKKKIVTIQELDVQLRNYLNKKYKLYEQGGDIVKGYVIYHNDDEKNVEYDFYNLNGEYGHEVLKMYADNKTINSDKLHLDIYLFKS

SEQ ID NO: 38473 - protein, 291 aa, Staphylococcus aureus; identical to SEQ ID NO: 30390
  subsp. aureus D139

SEQ ID NO: 38474 - protein, 891 aa, Staphylococcus aureus
  subsp. aureus D139
MNKHQPKLRSFYSIRKSTLGVASVIVSTLFLITSQHQAHAAENTNTSDKISENQNNNATTTQPPKDTNQTQPGTQPANTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGTETNYDYTKLVFAKPIYNDPSLVKSDTNDAVASNDQSSSDASNQTNTNTSNQNASTTNNTSDQPQATTNMSQPAQPKASANSDQASSQPAHETNSNDNTNDATNASSNQSNGNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDTKNNSRTLIFPYVPDKAVYNAIVKVVVANIGYEGQYHVRIINQDIKTKDDDTSQNNTSEHLNGQTVQEDKGTATDTATNNSIETTPSEATDKVDLIEPESDVVKVTDSNIDKDAHHDVDHLSDMSDNTHLDKYDLKEMDTQIAKDTDKGVDNSVGMTSNVDTDKGSNKNEGKVIQLAHNTDKNNHTGKAAKLDGVRQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 38475 - protein, 2182 aa, Staphylococcus aureus
  subsp. aureus D139
MNLLKKNKYSIRKYKVGIFSTLIGTVLLLSNPNGAQALTTDHNVQGGSNQALPGNSQNTNADTRRDNVNSSQNTPNAHATVNTSTNQALANHQNVDVASQVAPAPIQPSASPAQNNNNSNANSTATEPASNTNNHLASNNTTLNVPNNTNDNDSGRHLTLKEIQEDVRHSSDKPELVAIAEEASNRPKKRSRRAAPADPNATPADPAAGNGGAPVAITAPYTPTTDPNNNNIGQNAPNEALSFDDNNIRPSTNRSVPTVTVVDNLPGFTLINGGKVGVFSHAMVRTSMFDSGDAKNYQAQGNVIALGRIRGNDTNDHGDFNGIEKTLTVNPNSELIFEFNTMTTKNYQGMTNLVIKNADNDAVLGEKVVAYGPIWRLFKVPENVSHLKIQFSPKNDAITDARGIYQLRDGYKYYDFVDSIGLHSGSHLYVERRIMEPTATNNKEFTVTTSLKNNGNFGASFNTDDFVYKVQLPEGVEYVNNSLTKDFPSNNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNGLKRRAQTILDENRNNVPLNNRVSQADIDSLTNQMQHTLIRSVDAENAVNKKVDQMEDLVKQNDELTDEEKQAAIQVIEEHKNEIIGNIGDQTTDEGVTRIKDQGIQTLSGDTATPVVKPNAKKAIRDKAAKQREIINNTPDATQDEIQDALNQLTTDETDAIDNVTNATTNDDVETAKNNGINTIGAVAPQVTHKQAARDAINQATATKRQQINSNREATQEEKNAALNELTQATNHALEQINQATTNDDVDTAKGDGLNAINPIAPVTVVKQAARDAVTHDAQQHIAEINANPDATQEERQAAIDKVNAAVTAANTNILNANTNADVEQVKTNAIQGIQAITPATKVKTDAKNAIDKSAETQHNAIFNNNDATLEEQQAAQQLLDQAVATAKQNINAADTNQEVAQAKDQGTQNIVVIQPATQVKTDARNAVNNKAREVITNINATPGATREEKQEAINRVNTLKNRALTDIGVTSTTAMVNSIRDDAVNQIGAVQPHVTKKQTATGVLTDLATAKKQEINQNTNATTEEKQVALNQVDQELATAINNINQADTNGEVDQAQQLGTKAINAIQPNIVKKPAALAQINQHYNAKLAEINATPDATDDEKNAAINILNQDRQQAIESVKQANTNAEVDQAATTAENNIDAVLVDVVKKQAARDKITAEVAKRIEAVKQTPNATDEEKQAAVNQINQLKDQAFNQINQNQTNDQADTTTNQAINAIDNVEAEVVIKPKAIADIEKAVKEKQQQIDNSLDSTDNEKEVALQALAKEKEKALAAIDQAQTNSQVNQAATNGVSAIKIIQPETKVKPAAREKINQKANELRAQINQDKEATAEERQAALDKINDLVAKAMTNITNDRTNQQVNDSTNQALDDIALVTPDHIVRAAARDAVKQQYEAKKQEIEQAEHATDEEKQVALNQLANNEKRALQNIDQAIANNDVKRVESNGIATLKGVEPHIVVKPEAQQPIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIDALNKIVNAIKNDIAQNKTNAEVDQTEADGNNNIKVILPKVQVKPAARQSVSAKAEAQNALIDQSDLSTEEERLAAKHLVEQALNQAIDQINHADKTVQVNQNSIDAQNIISKIKPATTVKATALQQIQNIATNKINLIKANNEATDEEQNAAIAQVEKELIKAKQQIASAVTNADVAYLLHDGKNEIREIEPVINRKASAREKLTTLVNDKKQAIEANIQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMIDEDATLNDIKQHTQFIVDEILAIKLPAEATKVSPNVGQPAPKVCTPIKKEDKQEVSKVEKELPNTGSEEMDLPLKELALITGAALLARRRSKKEKES

SEQ ID NO: 38476 - protein, 331 aa, Staphylococcus aureus; identical to SEQ ID NO: 33525
  subsp. aureus D139

SEQ ID NO: 38477 - protein, 327 aa, Staphylococcus aureus
  subsp. aureus D139
MKMKKLVKSSVATSIALIMLSNTVDAAQHITPVSEKKVDDKITLYKTTATSDNDKLNISQILTFNFIKDKSYDKDTLVLKAAGNINSGYKKPNPKDYNYSYFYWGAKYNVSVSSESNDSVNVVDYAPKNQNEEFQVQQTLGYSYGGDINITNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNEAKKSKIKVTYQREMDRYTNYWNRLHWIGNNHKNQNTVTFTSTYEVDWHNHTVKLIDTNSKETNPGV

SEQ ID NO: 38478 - protein, 311 aa, Staphylococcus aureus
  subsp. aureus D139
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGAFNYSKTISYTQKSYVSEVDKQNSKSVKWGVKANEFVTPDGKKSAHDRYLFVQSPNGPSGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 38479 - protein, 258 aa, Staphylococcus aureus; identical to SEQ ID NO: 30442
  subsp. aureus D139

SEQ ID NO: 38480 - protein, 251 aa, Staphylococcus aureus
  subsp. aureus D139
MRLFYIAVIIITLLCLINNNYVNAEVDKKVLKKKSDIDSSNLFNLTSYYTDITWQLDESNKISTDQLLNNTIILKNIDISVLKTSSLKVEFNSADLANQFKGKNIDIYGLYYGNKCVGLTEEKTSCLYGGVTIHDGNQLDEEKVIGVNVFKDGVQQEGFVIKTKKAKVTVQELDTKVRFKLENLYKIYNKDTGNIQKGCIFFHSHNHQDQSFYYDLYNIKGSVGAEFFQFYSDNRTVSSSNYHIDVFLYKD

SEQ ID NO: 38481 - protein, 261 aa, Staphylococcus aureus
  subsp. aureus D139
MKLFAFIFICVKSCSLLFMLNGSPRPEQLNKASEFSGLMDNMRYLYDDKHVSETNIKAQEKFLQHDLLFKINGSKIDGSKILKTEFNNKSLSDKYKNKNVDLFGTNYYNQCYFSADNMELNDGRLIEKTCMYGGVTEHDGNQIDKNNLTDNSHNILIKVYENERNTLSFDISTNMKNITAQEIDYKVRNYLLKHKNLYEFNSSPYESGYIKFIEGNGHSFWYDMMPESGEKFYPTKYLLIYNDNKTVESKSINVEVHLTKK

SEQ ID NO: 38482 - protein, 242 aa, Staphylococcus aureus
  subsp. aureus D139
MKKIKYSFILVFILFFNIKDLSYAQGDIGVGNLRNFYTKYDYIDLKGVTDKNLPIANQLEFSTGTNDLISESNNWDEISTFKGKKLDIFGIDYNGPCKSKYMYGGVTLSGQYLNSARKIPINLWVNGKHKTISTDKIATNKKLVTAQEIDVKLRRYLQEEYNIYGHNNTGKGKEYGYKSKFYSGFNKGKVLFHLNDEKSFSYDLFYTGDGLPVSFLKIYEDNKIIESEKFHLDVEISYVDSN

SEQ ID NO: 38483 - protein, 239 aa, Staphylococcus aureus
  subsp. aureus D139
MKRILIIVVLLFCYSQNHIATADVGVLNLRNYYGSYPIESHQNINPDNNSLSHQLVFSKDNSTVTAEFKNVEDVKKFKNRAVDVYGLSYSGYCLKNKYMYGGVTLAGDYLEKSRCIPINLWVNGNHKTISTDKVSTNKKIVTAQEIDTKLRRYLQEEYNIYGFNDTNKGRNYGTKSKFFSGFNTGKISFHLNDGTSFSYDLFDTGTGQAESFLKIYNDNKTVETDKFHLDVEISYKDES

SEQ ID NO: 38484 - protein, 254 aa, Staphylococcus aureus
  subsp. aureus D139
MLNVLLLIIYLIAICSVNNAYANEENPKIEDLCKKSSVDDIALHNIDKDYMTNRFIINESPVLTTEKFLDFDLLFKNFTWLDGKSVEFKDLKVEFSSSEISKEYFGKTVDIYGVYYKAHCHGEHQVKTACTYGGVTPHENNKLNEPKEIGVAVYKDNVNVNTFIVTTDKKKVTAQELDIKVRTKLNNVYKLYDRMTSDVQKGYIKFHSHSEHKESFYYDLFYIKGNLPDQYLQIYNDNKTIDSSDYHIDVYLFT

SEQ ID NO: 38485 - protein, 686 aa, Staphylococcus aureus
  subsp. aureus D139
MKFKSLVTTTLALGVIASTGANFNTNEASAAAKQLVKSSSSLHHGHSKIQVPYTITVNGTSQNILSSLTFNKNQQISYKDIENKVKSVLYFNRGISDIDLRLSKQAKYTVHFKNGAKRVVDLKAGIYTADLINTSDIKAISVNVDTKKQEKDKEAKANVQVPYTITVNGTSQNILSNLTFKKNQQISYKDLENNVKSVLKSNRGITDVDLRLSKQAKYTVVFKNGTKKVIDLKAGIYTANLINSSDIKNININVDTKKQAKDKAKTSTQVPYSINLNGTSTNILSNLSFSNKPWTNYKNLTDKVKSVLKSNRGVSERDLKHAKKAYYTVYFKNGGKRVIHLNSNVYTANLVHAKDIKKIEVTVKTGSKAKAERYVPYTIAVNGTSTPNLSDLKFTGDSRVSYSDITKKVKSVLKHDRGIGERELRYAKKATYTVHFKNGTKKVINLNSKISQLNLLFVKDIKKIDIDVKTGSKAKADSYVPYTIAVNGTSTPILSKLKLSNKQLIGYQDLNEKVKSVLKHDRGINDIELKFAKQAKYTIHFKNGKTQVVDLKSDIFTRNLFSVKDIKKIDINVKQHTKANKEVKKATNNKVNFPVTINGFSNIVSNEFVFYNASKITINDLSTKLKSAMANDQGITKHDIGLAERAVYKVYFKDGTSKYVDLKTEYKDAKVFKASDVKKVDIEIKF

SEQ ID NO: 38486 - protein, 274 aa, Staphylococcus aureus
  subsp. aureus D139
MYPNWGQYKRADLIGQSNYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 38487 - protein, 338 aa, Staphylococcus aureus
  subsp. aureus D139
MIKQVCKNITICSLALSTALTIFPASSYAKINSEIKQVSEKNLDGETKMYTRTATTSDSQKNITQSLQFNFLTEKNYDKETVFIKAKGTIGSGLRILEPNGYWNSTLRWPGSYSVSIQNVDDNNNTNVTDFAPKNQDESREVKYTYGYKTGGDFSINQGGLTGNITKESNYSETISYQQPSYRTLIDQPTTNKGVAWKVEAHLINNMGHDHTRQLTNDSDDRVKSEIFSLTRNGNLWAKDNFTPKNKMPVTVSEGFNPEFLAVMSHDKKDEGKSKFVVHYKRSMDEFKIDWNKHGFWGYWSGENHVDKKEEKLSALYEVDWKTHNVKFIKVLNDKEKK

SEQ ID NO: 38488 - protein, 351 aa, Staphylococcus aureus
  subsp. aureus D139
MKNKKRVFIASSLSCALLLLSAANTEANSANKDSQDQTKKEHVDKAQQKEKRNVNDKDKNTPGPDDIGKNGKVTKRTETVYDEKTNILQNLQFDFIDDPTYDKNILLVKKQGSIHSNLKFESHKEENNSSWLKYPSEYHVDFQVKRNRKTEILDQLPKNKISTAKVDSTFSYNSGGKFDSVKGVGRTSSNSYSKTISYNQQNYDTIASGKNNNWHVHWSVVANDLKYGGEVKNRNDEFLFYRTTRLSTVENPELSFASKYRYPALVRSGFNPEFLTYLSNEKSNEKTQFEVTYTRNQDILKNKPGIHYAPPILEKNKDGQRLIVTYEVDWKNKTVKVIDKYSDDNKPYKEG

SEQ ID NO: 38489 - protein, 231 aa, Staphylococcus aureus; identical to SEQ ID NO: 30654
  subsp. aureus D139

SEQ ID NO: 38490 - protein, 2482 aa, Staphylococcus aureus
  subsp. aureus D139
MNLFRQQKFSIRKFNVGIFSALIATVTFISINPTTASAAEQNQPAQNQPAQPADANAQPNANAGAQANPTAQPAAPANQGQPAAQPANQGGQANPAGGAAQPAGGAAQPAGQGNQADPNNAVQAQPGNQAAPANQAGQGNNQATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYKEVKQAATARKAQNATVSNTTNEEVAEADAAVDAAQTEGLHDIQVVKSQQEVADTKAKVLDKINAIQTQARVKPAADTEVENAYNTRKQEIQNSNASTTEEKEAAYTQLDDKKQEARTNIDAANSNSEVATAKDNSIAAINQVQAATTKKSDAKAEIAQKASERKTAIEAMNDSTTEEQQAAKDKVDQAVVTANADIDNAAANNDVDNAKTTNEATIAAITPDANVKPQAKQAIADKVQAQETAIDANNGATTEEKAAAKQQVQTEKTTADAAIDGAHSNAEVEAAKNAEIAKIEAIQPATTTKDDAKQAIATKANERKAAIAQTQDITVEEIEAANADVDNAVTQANSNIEAANSQNDVDQAKTTGEASIDQVTPTVNKKATARNEITTTLNNKLQAIQATPDATDEEKQAAETEANTENAKANQAITAATTNAEVDEAKTNAEAAINAVTPKVMKKQAAKDEIDQLQTAQTAVINNDQNATNEEKAAAIQQLATAVTDAKNNITAATDNNGVDTAKDAGKNSIQSTHPATAVKSNAKNEVDQAVTTQNQTIDNTTGATTEEKNAAKDLVSKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLTEMQNKITEILNNNETTNEEKEKGIVPVRAAYVEGLENINAASTTGDVTTAKDTAVQKVQQLHANPVKKPSGKTALEQAAADKKTQIEQTPNASQQEINDAKQEVDTELNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNSDVDDALTQGKATIDAVQVDAAVKPKANQVIDAKAEETTESIDQSEQLTAEEKTEALATIKQITDQAKQGITDATTTAEVEKAKAQGLEALDNIQIDSTEKQKAIEELETALDQIEAGVNVDADATTEEKEAFTNALEDILSKATEDISDQTTNAEIATVKNNALEQLKAQRINPVVKKNALEAIREVVNKQIEIIKNADADASAKEIARTDLGRYFDRFADNLDKTQTNTEVAELQNVTIPAIEAIVPQNDPNANDTNSGSDNNDATANSNANATPENTGQPNVTESTDNANADTSSATTNNHNDAATGGTTATSTNNSSTDDANNKPTANNNSSVDASTDNSATGNGTTDKPAVESTNNGTTDKPATETDNATPAEGTTNNNSTTATNENAPTGSTATAPTTNASTGAASSADSKDNASVNDSKQNAEVNNGAESQSTNGKVAQPKSENKAKDEKDGRDSTNQSMVESTTKTLPSADITEPKVPSNTEKDKEESTTNQTDAGQLKSETNVASNEADKSEGNVDTDVSNKPSTSKPSEVKDKTTSTEDSQKADMATADTKDNQAAIGATADVNNKATQNDGANASPATVSNGSNSANQDMLKVTNTDKHKAKATSAQQGKENKAKQQAKTLPDTGMSHNDDLPYAELALGAGMAFLIRRFTKKDQQTEE

SEQ ID NO: 38491 - protein, 807 aa, Staphylococcus aureus
  subsp. aureus D139
MTYRMKKWQKLSTITLLMAGVIILNGGEFRSIDKHQIAVANTNVQTPDYEKLRNTWLDVNYGYDKYDESNDAMKKKFDATESEAKNLLSSMKTESGRTYLWDSAKDLDNKSADMTRTYRNIEKIAEAMKHKDTKLKTDENKKKVKDALDWLHENAYGKEPDKKVKELTSNFKNKTSRNTNLNWWDYEIGTPRALTNTLILLNDQFSNEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFKDSNQNDTTLKSWIDDGFMPLIYKGEMMDLSRGRAISRENETSHSASATVMKSLLRLSDAMDDSTKAKYKQIVKNSVKSDSSYDQNDTLSSYSDISKMKSLMEDSTISTNGLTQQLKIYNDMDRVTYHNKDLDFAFGLSMTSKNVARYESINNENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTASSKNPVTTIENRKANGYTMYTDDKQTTASDNQETNSVFLESTDTKKNIGYHFLNKAKITVKKESHIGKWSEINKSQKDTQKTDEYYEVTQKHSDKDDKYGYVLYPGLSKDDFKTKKDEVTVVKQEDDFHVVKDNESVWAGVNYSDSAKTFDINNTKVEVKAKGMFILKKKDDNTYECSFYNPESTNSASDIESKISMTGYSITNKNTSTSNESGVRFELTK

SEQ ID NO: 38492 - protein, 141 aa, Staphylococcus aureus; identical to SEQ ID NO: 31189
  subsp. aureus D139

SEQ ID NO: 38493 - protein, 321 aa, Staphylococcus aureus; identical to SEQ ID NO: 30959
  subsp. aureus D139

SEQ ID NO: 38494 - protein, 315 aa, Staphylococcus aureus
  subsp. aureus D139
MLKNKILAATLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDPNISLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 38495 - protein, 325 aa, Staphylococcus aureus
  subsp. aureus D139
MKMNKLVKSSVATSMALLLLSNTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 38496 - protein, 743 aa, Staphylococcus aureus
  subsp. aureus D139
MKNNLRYGIRKHKLGAASVFLGTMIVVGMGQDKEAAASEQKTTTVEENGNSATDNKVNATQTTTTNVNHIEETQPYNATVTEQPSNATQVTTEEAPKAAVQAPQTAQPANVETVKEEVVKEEAKPQVKETTQSQDNSGDQRQVDLTPKKATQNQAAETQVEVAQPRTVSESKPRVTRSADVVEASDVSEVKGTDVTSKVTVTESSIEGHNNTNKVEPHEGQRAILKYKLKFENGLHQGDFFDFTLSKNVNTHGVSTARKVPDIKNGSVVMATGKILEDGKIRYTFTNDVEHKVEVTANLEINLFIDPKTFQSNGEEKVTSSLNGSKTEKNLKIEYKNGVGTYYANVNGSIETFDKEKNKFTHVAYVKPLNQFKLGTVTVSGTVTQGSNPNGEKPTVKIYEVTNDGKDLPQSVYLDASDKNKYKDVTNEMQSKLTVQENGNYTLNLDTLDKSYVIHYSGEYLNGTNEVNFRTQMFGYPEQRYGYYYNSYQLTWDNGLVLYSNKADGNGKNGQIIQNNDFEYKEDTLTETVTGQYDEKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGG

SEQ ID NO: 38497 - protein, 233 aa, Staphylococcus aureus; identical to SEQ ID NO: 31111
  subsp. aureus D139

SEQ ID NO: 38498 - protein, 214 aa, Staphylococcus aureus
  subsp. aureus D139
MNKMKKVISLFVAILSVLIFTDNANAENNKPEGVNENSNLIPVRQPDANYPGPVSDIARVKKLDNLIDGTKDPDVIKQLKDDNEAPNNAVKAKDSKIVSDCRHLLKHPDNLIDGTKDPNVINQLKNANGTSNNSAVNPSIKANDVHTKSNKQMAKQQSIHLYSKSKSGHKQQLKELPKTGVNNESNTAIMALFIGLILLVVSLVTRFIKLNSHQ

SEQ ID NO: 38499 - protein, 918 aa, Staphylococcus aureus
  subsp. aureus D139
MSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSEPSVRTRAVRSLAVAEPVVNAADAKGTNVNDKVTASDFKLEKTTFDPNQSGNTFMAANFKVAGKVKSGDYFTAKLPDSVTGNGDVDYSNSNNTMPIADIVNDKKEVVAKATYDILTKTYTFVFTDYVNDKENINGQFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPDPEPEPTPDPEPSPDPDPEPTPDPEPSPEPDPDSDSDSDSGSDSDSGSDSDSDSDSDSDSDSDSDSDSDSDSDSDSESDSDSDSDSDSDSDSDSDSDSDSDSDSDSDSDSDSDSDSDSESDSDSDSDSDSDSDSDSDSDSDSNSDSESDSDSDSDSDSDSESDSESDSDSDSESDSDSDSDSESDSDSDSDSDSDSDSDSESDSDSDSDSDSDSESDSESDSDSDSDSDSDSDSDSDSDSDSDSDSDSESDSDSDSDSDSDSDSDSDSDSDSESDSDSDSDSRVTPPNNEQKAPSNPKGEVNHSNKASKQHQTDALPETGDKSENTNATLFGAMMALLGSLLLFRKRKQDHKEKA

SEQ ID NO: 38500 - protein, 111 aa, Staphylococcus aureus; identical to SEQ ID NO: 36278
  subsp. aureus D139

SEQ ID NO: 38501 - protein, 681 aa, Staphylococcus aureus; identical to SEQ ID NO: 35560
  subsp. aureus D139

SEQ ID NO: 38502 - protein, 246 aa, Staphylococcus aureus; identical to SEQ ID NO: 35517
  subsp. aureus D139

SEQ ID NO: 38503 - protein, 110 aa, Staphylococcus aureus; identical to SEQ ID NO: 36281
  subsp. aureus D139

SEQ ID NO: 38504 - protein, 325 aa, Staphylococcus aureus; identical to SEQ ID NO: 30484
  subsp. aureus DR10

SEQ ID NO: 38505 - protein, 315 aa, Staphylococcus aureus; identical to SEQ ID NO: 35728
  subsp. aureus DR10

SEQ ID NO: 38506 - protein, 279 aa, Staphylococcus aureus; identical to SEQ ID NO: 35955
  subsp. aureus DR10

SEQ ID NO: 38507 - protein, 291 aa, Staphylococcus aureus; identical to SEQ ID NO: 30390
  subsp. aureus DR10

SEQ ID NO: 38508 - protein, 895 aa, Staphylococcus aureus; identical to SEQ ID NO: 31177
  subsp. aureus DR10

SEQ ID NO: 38509 - protein, 2182 aa, Staphylococcus aureus
  subsp. aureus DR10
MNLLKKNKYSIRKYKVGIFSTLIGTVLLLSNPNGAQALTTDHNVQGGSNQALPGNSPNTNADTNRDIVNGSQNTPNAHATDNTSTNQALTNHQNVGVANQVAPAPIQPSTSSASNNNHSDANSTATEPAANTNNNLASNNNTLNVPNNTDNNDSARHLTLKEIQEDVRHSSDKPELVAIAEEASNRPKKRSRRAAPADPNATPADPTAGNGSAPVAITAPFTPTTDPNANNIGQNAPNEVLTFDDNNIRPSTNRSVPTVTVVDNLPGYTLINGGKVGVFSHAMVRTSMFDSGDAKNYQAQGNVIALGRIKGNDTNDHGGFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDILTYKTYTQDFINSPAESHTVSTNPYTIDIIMNKDVLQAEVDRRIQQADYTFASLDIFNELKRRAQTILDENRNNVPLNKRVSQADIDSLVNQMQHTLIRSVDAENAVNRKVDDMEDLVNQNDELTDEEKQAAIQVIEEHKNEIIGNIGDQTTDDGVTRIKDQGIQTLSGDTATPVVKTNAKQAIRDKAAKQREIINNTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAAANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALNDIGVTSTTAMVNSIRDDAVNQIGAVQPHVTKKQTATGVLTDLATAKKQEINQNTNATDEEKQVALNQVDQDLATAINNINQADTNAEVDQAQQLGTKAINAIQPNIVKKPTALAQINQHYNAKLAEINATPDATDDEKNAAINTLNQDRQQAIESIKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAKVVIKPKAIADIEKAVKEKQQQIDNSLDSTDNEKEVALLALAKEKEKALAAIDQAQTNSQVNQAATNGVSAIKIIQPETKVKPAAREKINQKANELRAQINQDKEATAEERQAALDKINDLVAKAMTNITNDRTNQQVNDSTNQALDDIALVTPDHIVRATARDAVKQQYEAKKHEIEQAEHATDEEKQVALNQLANNEKRALQNIDQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIASAVTNADVAYLLHDGKNEIREIEPVINKKATAREQLTTLFNDKKLAIEANVQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGIRMIDEDATLNDIKQHTQFIVDEILAIKLPAEATKVLPKVGQPAPKLCTSIKKVDKQEVRKVVKELPNTGSEEMDLPLKELALITGAALLARRRNKNEKES

SEQ ID NO: 38510 - protein, 350 aa, Staphylococcus aureus; identical to SEQ ID NO: 35959
  subsp. aureus DR10

SEQ ID NO: 38511 - protein, 844 aa, Staphylococcus aureus; identical to SEQ ID NO: 35960
  subsp. aureus DR10

SEQ ID NO: 38512 - protein, 251 aa, Staphylococcus aureus; identical to SEQ ID NO: 35953
  subsp. aureus DR10

SEQ ID NO: 38513 - protein, 273 aa, Staphylococcus aureus; identical to SEQ ID NO: 35952
  subsp. aureus DR10

SEQ ID NO: 38514 - protein, 253 aa, Staphylococcus aureus; identical to SEQ ID NO: 35951
  subsp. aureus DR10

SEQ ID NO: 38515 - protein, 333 aa, Staphylococcus aureus; identical to SEQ ID NO: 35950
  subsp. aureus DR10

SEQ ID NO: 38516 - protein, 165 aa, Staphylococcus aureus; identical to SEQ ID NO: 31169
  subsp. aureus DR10

SEQ ID NO: 38517 - protein, 109 aa, Staphylococcus aureus; identical to SEQ ID NO: 35948
  subsp. aureus DR10

SEQ ID NO: 38518 - protein, 354 aa, Staphylococcus aureus; identical to SEQ ID NO: 31167
  subsp. aureus DR10

SEQ ID NO: 38519 - protein, 642 aa, Staphylococcus aureus; identical to SEQ ID NO: 35946
  subsp. aureus DR10

SEQ ID NO: 38520 - protein, 314 aa, Staphylococcus aureus
  subsp. aureus DR10
MSDSDSASDSDSDSDSDSDSDSDSDSDSDSDSDSDSDSDSDSDSDSDSDSDSDSDSDSDSDSDSDSDSDSDSDSESDSDSDSDSESESDSDSDSDSDSDSDSDSDSDSDSDSDSDSDSDSDSDSDSDSDSASDSDSDSDSDSDSDSDSDSDSDNDSDSDSDSDSASDSDSGSDSDSSSDSDSDSASDSDSDSDSASDSDSGSDSDSSSDSDSDSASDSDSDSDSTSDTGSDNDSDSESDSNSDSESGSNNNVVPPNSPKNGTNASNKNEAKDSKEPLPDTGSEDEANTSLIWGLLASLGSLLLFRRKKENKDKK

SEQ ID NO: 38521 - protein, 321 aa, Staphylococcus aureus; identical to SEQ ID NO: 31190
  subsp. aureus DR10

SEQ ID NO: 38522 - protein, 318 aa, Staphylococcus aureus; identical to SEQ ID NO: 35971
  subsp. aureus DR10

SEQ ID NO: 38523 - protein, 325 aa, Staphylococcus aureus; identical to SEQ ID NO: 30479
  subsp. aureus DR10

SEQ ID NO: 38524 - protein, 951 aa, Staphylococcus aureus; identical to SEQ ID NO: 35973
  subsp. aureus DR10

SEQ ID NO: 38525 - protein, 1011 aa, Staphylococcus aureus
  subsp. aureus DR10
MHLKGDIIVKNNLRYGIRKHKLGAASVFLGTMIVVGMGQDKEAAASEQKTTTVEENGNSATENKTSETQTTATNVNHIEETQSYNATVTEQPSNATQVTTEEAPKAVQAPQTAQPANVETVKEEVVKEEAKPQVKETTQSQDNSGDQRQVDLTPKKATQNQAAETQVEVAQPRTVSESKPRVTRSADVVEAKEASDASEIKGTDVTSKVTVTESSIEGHNNTNKVEPHAGQRAVLKYKLKFEDGLKKGDYFDFTLSNNVNTYGVSTARKLPEIKNGSVVMATGQLLGDGKIRYTFTDYIDYKVNVIANLNLNLFIDPRIVKNNGEETLTSKLNGKNTEKKIEVEYKDGVGKYYTNLNGSIETFNKADNKFTHVAYVKPINGNKSESVSITGSLTQGSNVSGDSPIVKVYEYQGKETDLPKSVSVNLTDNSKFKDVTSDMQNKLTVQENGNYQLNLEKLDKTYVIHYTGEYSKETDEVNFRTQVSAYPENSYRYYSYYNNHYTLTWDNGLVLYSNKADGNGQNGVKVESNNLIFDEVTGTGVITGQYDKNLVTTVEEETDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPTPEVPAEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 38526 - protein, 691 aa, Staphylococcus aureus; identical to SEQ ID NO: 35930
  subsp. aureus DR10

SEQ ID NO: 38527 - protein, 93 aa, Staphylococcus aureus; identical to SEQ ID NO: 32126
  subsp. aureus DR10

SEQ ID NO: 38528 - protein, 594 aa, Staphylococcus aureus
  subsp. aureus DR10
MNMKKQEKHAIRKKSIGVASVLVGTLIGFGLLSSKEADASENSMTQTENTRNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDTSTEVTPSNNESAPQSTDASNKDVVNQTVNTSASRMRAFSLAAADAPAVGTDITNQLTNVTVGIDSGTTVYPHQAGYVKLNYGFSVPNSAVQGDTFKITVPKELNLNGVTSTAKVPPIMAGDQVLANGVIDSDGNVIYTFTDYVDTKNDVKATLTVPAYIDPENVTKTGNVTLTTGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSD

SEQ ID NO: 38529 - protein, 434 aa, Staphylococcus aureus [sequence omitted]

SEQ ID NO: 38530 - protein, 231 aa, Staphylococcus aureus; identical to SEQ ID NO: 30654
  subsp. aureus DR10

SEQ ID NO: 38531 - protein, 2459 aa, Staphylococcus aureus; identical to SEQ ID NO: 32108
  subsp. aureus DR10

SEQ ID NO: 38532 - protein, 689 aa, Staphylococcus aureus; identical to SEQ ID NO: 31181
  subsp. aureus DR10

SEQ ID NO: 38533 - protein, 274 aa, Staphylococcus aureus; identical to SEQ ID NO: 30872
  subsp. aureus DR10

SEQ ID NO: 38534 - protein, 338 aa, Staphylococcus aureus; identical to SEQ ID NO: 31183
  subsp. aureus DR10

SEQ ID NO: 38535 - protein, 372 aa, Staphylococcus aureus; identical to SEQ ID NO: 35964
  subsp. aureus DR10

SEQ ID NO: 38536 - protein, 45 aa, Staphylococcus aureus; identical to SEQ ID NO: 31097
  subsp. aureus DR10

SEQ ID NO: 38537 - protein, 226 aa, Staphylococcus aureus; identical to SEQ ID NO: 31160
  subsp. aureus DR10

SEQ ID NO: 38538 - protein, 227 aa, Staphylococcus aureus; identical to SEQ ID NO: 31159
  subsp. aureus DR10

SEQ ID NO: 38539 - protein, 232 aa, Staphylococcus aureus; identical to SEQ ID NO: 31158
  subsp. aureus DR10

SEQ ID NO: 38540 - protein, 231 aa, Staphylococcus aureus; identical to SEQ ID NO: 31157
  subsp. aureus DR10

SEQ ID NO: 38541 - protein, 239 aa, Staphylococcus aureus; identical to SEQ ID NO: 35936
  subsp. aureus DR10

SEQ ID NO: 38542 - protein, 322 aa, Staphylococcus aureus; identical to SEQ ID NO: 35935
  subsp. aureus DR10

SEQ ID NO: 38543 - protein, 348 aa, Staphylococcus aureus; identical to SEQ ID NO: 35934
  subsp. aureus DR10

SEQ ID NO: 38544 - protein, 238 aa, Staphylococcus aureus; identical to SEQ ID NO: 35933
  subsp. aureus DR10

SEQ ID NO: 38545 - protein, 231 aa, Staphylococcus aureus; identical to SEQ ID NO: 35932
  subsp. aureus DR10

SEQ ID NO: 38546 - protein, 591 aa, Staphylococcus aureus
  subsp. aureus DR10
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTKDANSIATNSELKNPQTLDLPQSSPQTISNAQGTSKPSVRTRAVRSLTVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFNNRIFYEHPNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPEPEPTPD

SEQ ID NO: 38547 - protein, 2279 aa, Staphylococcus aureus; identical to SEQ ID NO: 31197
  subsp. aureus DR10

SEQ ID NO: 38548 - protein, 684 aa, Staphylococcus aureus; identical to SEQ ID NO: 35978
  subsp. aureus DR10

SEQ ID NO: 38549 - protein, 233 aa, Staphylococcus aureus; identical to SEQ ID NO: 31195
  subsp. aureus DR10

SEQ ID NO: 38550 - protein, 70 aa, Staphylococcus aureus; identical to SEQ ID NO: 31174
  subsp. aureus DR10

SEQ ID NO: 38551 - protein, 215 aa, Staphylococcus aureus
  subsp. aureus DR10
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKK

SEQ ID NO: 38552 - protein, 241 aa, Staphylococcus aureus; identical to SEQ ID NO: 31149
  subsp. aureus DR10

SEQ ID NO: 38553 - protein, 738 aa, Staphylococcus aureus
  subsp. aureus DR10
MNNKKTATNRKGMIPNRLNKFSIRKYSVGTASILVGTTLIFGLSGHEAKAAEHTNGELNQSKNETTVPTENKTTEKVDSRQQNNIEQSTTSNQPKVNESDNTSVKETTEEPQNTTSTQSTKQNNDATANKDNLEAQNISTQAKDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLKEVTNQFNITYSNDNKTATVDLLNGQTSSNKQYIIQQVAYPDNTSTDNGKIDYTLETQNGKSSWSNSYSSVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSD

SEQ ID NO: 38554 - protein, 1093 aa, Staphylococcus aureus
  subsp. aureus DR10
MINRDNKKAITKKGMISNRLNKFSIRKYTVGTASILVGTTLIFGLGNQEAKAAENTSTENAKQDEASTSDNKEVVSETENNSTTENTSTNPIKKETNTDSQPETKEESTTSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDRSTKPVATAPTSVAPKRLNAKMRFAVAQPAAVASNNVNDLIKVTKQTIKVGDGKDDVVAAHDGEEIEYDSEFTIDNKVKAGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQNIEQQIYVNPLKKTATNTKVDIAGSQVDDYGNIKLGNGSTIIDQNTEIKVYKVNSNQQLPQSNRIYDFSQYEDVTSQFDNKKSFSNNVATLDFGNIDSAYIIKVVSKYTPTSDDELDIAQGASMRTTDKNNYYNYAGYSNFIVTSTDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKIIGTTTTDASGKYKFTDLDNGNYTVEFETPAGYTPTLKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTIDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDTGKHIPVKPMSATKDHDNKAKALPETGSENNGSNNATLFGGLFAALGSLLLFGRRKKQNK

SEQ ID NO: 38555 - protein, 115 aa, Staphylococcus aureus
  subsp. aureus DR10
DSDSDSDSDSDSDSDSDSDSDSDSDSDSDSDSDSDSDSDSDSDSDSDSDSDSDSDAGKHTPVKPMSATKDHQNKAKALPETGSENNGSNNATLFGGLFAVLGSLLLFGRRKKQNK

SEQ ID NO: 38556 - protein, 98 aa, Staphylococcus aureus
  subsp. aureus DR10
GNGIHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38557 - protein, 141 aa, Staphylococcus aureus; identical to SEQ ID NO: 31189
  subsp. aureus DR10

SEQ ID NO: 38558 - protein, 811 aa, Staphylococcus aureus; identical to SEQ ID NO: 35968
  subsp. aureus DR10

SEQ ID NO: 38559 - protein, 1158 aa, Staphylococcus aureus
  subsp. aureus DR10
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVASEKNNNSQPSENGKLQTSDVKKTEANNTTLDDQVTTTVNSQQLNTDNTTSNATMSSAPINVSKDDLKINNEEVRNVGEKSDNADNANGSDVIMPKSTAPKRLNTRMRMAAIQSTSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSVYMDADTIPVDKKDVPFSVTIGNQTTTTTADITYPAYKEADNNSIGSAFTETVSHAGNAEDPGYYNQVVYVNPMDKDLKGANLKVEAYHPKYPANIGQINQNVTNIKIYRVPEGYTLNKGYDVNANDLVDVTDEFKNKMTYGTNQSVNIDFGDITSAYVVMVNTKFQYTNSESPTLVQMATLSSTGNKTVSTGNALGFTNNQSGGAGQEVYKIGNYVWEDTNKNGVQELGEKGVGNVTVTVFDNNTNTKVGEAVTKEDGSYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDEKGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSDSDSDSDSDSDSD

SEQ ID NO: 38560 - protein, 137 aa, Staphylococcus aureus
  subsp. aureus DR10
DSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNNAKALPETGSENNGSNNATLFGGLFAALGSLLLFGRRKKQNK

SEQ ID NO: 38561 - protein, 283 aa, Staphylococcus aureus
  subsp. aureus DR10
EPSPEPEPEPTPDPEPSPEPEPEPTPDPEPSPEPEPEPTPDPEPSPDPDPDSDSDSDSGSDSDSDSDSDSDSDSDSDSDSDSESDSDSDSESDSESDSDSDSDSDSDSDSDSDSDSDSNSDSESDSDSDSDLDSDSDSDSDSDSDSDSDSDSDSDSDSDSESDSDSDSDSDSDSDSDSESDSDSDSDSDSDSDSDSDSDSDSDSDSDSDSRVTPPNNEQKAPSNPKGEVNHSNKASKQHQTDALPETGDKSENTNATLFGAMMALLGSLLLFRKRKQDHKEKA

SEQ ID NO: 38562 - protein, 917 aa, Staphylococcus aureus; identical to SEQ ID NO: 31037
  subsp. aureus DSM 20231

SEQ ID NO: 38563 - protein, 233 aa, Staphylococcus aureus; identical to SEQ ID NO: 30428
  subsp. aureus DSM 20231

SEQ ID NO: 38564 - protein, 877 aa, Staphylococcus aureus; identical to SEQ ID NO: 31708
  subsp. aureus DSM 20231

SEQ ID NO: 38565 - protein, 681 aa, Staphylococcus aureus; identical to SEQ ID NO: 32025
  subsp. aureus DSM 20231

SEQ ID NO: 38566 - protein, 241 aa, Staphylococcus aureus; identical to SEQ ID NO: 30776
  subsp. aureus DSM 20231

SEQ ID NO: 38567 - protein, 2271 aa, Staphylococcus aureus; identical to SEQ ID NO: 31839
  subsp. aureus DSM 20231

SEQ ID NO: 38568 - protein, 690 aa, Staphylococcus aureus; identical to SEQ ID NO: 30419
  subsp. aureus DSM 20231

SEQ ID NO: 38569 - protein, 232 aa, Staphylococcus aureus; identical to SEQ ID NO: 31054
  subsp. aureus DSM 20231

SEQ ID NO: 38570 - protein, 225 aa, Staphylococcus aureus; identical to SEQ ID NO: 30763
  subsp. aureus DSM 20231

SEQ ID NO: 38571 - protein, 516 aa, Staphylococcus aureus
  subsp. aureus DSM 20231
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDNNKPGKEDNNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38572 - protein, 321 aa, Staphylococcus aureus; identical to SEQ ID NO: 30959
  subsp. aureus DSM 20231

SEQ ID NO: 38573 - protein, 356 aa, Staphylococcus aureus; identical to SEQ ID NO: 31755
  subsp. aureus DSM 20231

SEQ ID NO: 38574 - protein, 231 aa, Staphylococcus aureus; identical to SEQ ID NO: 30560
  subsp. aureus DSM 20231

SEQ ID NO: 38575 - protein, 141 aa, Staphylococcus aureus; identical to SEQ ID NO: 30715
  subsp. aureus DSM 20231

SEQ ID NO: 38576 - protein, 203 aa, Staphylococcus aureus; identical to SEQ ID NO: 30770
  subsp. aureus DSM 20231

SEQ ID NO: 38577 - protein, 308 aa, Staphylococcus aureus; identical to SEQ ID NO: 31763
  subsp. aureus DSM 20231

SEQ ID NO: 38578 - protein, 232 aa, Staphylococcus aureus; identical to SEQ ID NO: 30765
  subsp. aureus DSM 20231

SEQ ID NO: 38579 - protein, 231 aa, Staphylococcus aureus; identical to SEQ ID NO: 30768
  subsp. aureus DSM 20231

SEQ ID NO: 38580 - protein, 315 aa, Staphylococcus aureus; identical to SEQ ID NO: 30440
  subsp. aureus DSM 20231

SEQ ID NO: 38581 - protein, 231 aa, Staphylococcus aureus; identical to SEQ ID NO: 31761
  subsp. aureus DSM 20231

SEQ ID NO: 38582 - protein, 96 aa, Staphylococcus aureus; identical to SEQ ID NO: 30813
  subsp. aureus DSM 20231

SEQ ID NO: 38583 - protein, 995 aa, Staphylococcus aureus
  subsp. aureus DSM 20231
MIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNEKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 38584 - protein, 196 aa, Staphylococcus aureus; identical to SEQ ID NO: 30587
  subsp. aureus DSM 20231

SEQ ID NO: 38585 - protein, 2478 aa, Staphylococcus aureus; identical to SEQ ID NO: 31716
  subsp. aureus DSM 20231

SEQ ID NO: 38586 - protein, 351 aa, Staphylococcus aureus; identical to SEQ ID NO: 30720
  subsp. aureus DSM 20231

SEQ ID NO: 38587 - protein, 327 aa, Staphylococcus aureus; identical to SEQ ID NO: 30538
  subsp. aureus DSM 20231

SEQ ID NO: 38588 - protein, 338 aa, Staphylococcus aureus; identical to SEQ ID NO: 30699
  subsp. aureus DSM 20231

SEQ ID NO: 38589 - protein, 909 aa, Staphylococcus aureus
  subsp. aureus DSM 20231
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESVSNNNVVPPNSPKNGTNASNKNEAKDSKEPLPDTGSEDEANTSLIWGLLASIGSLLLFRRKKENKDKK

SEQ ID NO: 38590 - protein, 44 aa, Staphylococcus aureus; identical to SEQ ID NO: 30513
  subsp. aureus DSM 20231

SEQ ID NO: 38591 - protein, 895 aa, Staphylococcus aureus; identical to SEQ ID NO: 31734
  subsp. aureus DSM 20231

SEQ ID NO: 38592 - protein, 331 aa, Staphylococcus aureus; identical to SEQ ID NO: 30732
  subsp. aureus DSM 20231

SEQ ID NO: 38593 - protein, 2186 aa, Staphylococcus aureus
  subsp. aureus DSM 20231
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTIDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNANVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 38594 - protein, 226 aa, Staphylococcus aureus; identical to SEQ ID NO: 30769
  subsp. aureus DSM 20231

SEQ ID NO: 38595 - protein, 234 aa, Staphylococcus aureus; identical to SEQ ID NO: 31052
  subsp. aureus DSM 20231

SEQ ID NO: 38596 - protein, 227 aa, Staphylococcus aureus; identical to SEQ ID NO: 30585
  subsp. aureus DSM 20231

SEQ ID NO: 38597 - protein, 434 aa, Staphylococcus aureus [sequence omitted]

SEQ ID NO: 38598 - protein, 325 aa, Staphylococcus aureus; identical to SEQ ID NO: 30407
  subsp. aureus DSM 20231

SEQ ID NO: 38599 - protein, 807 aa, Staphylococcus aureus; identical to SEQ ID NO: 30716
  subsp. aureus DSM 20231

SEQ ID NO: 38600 - protein, 291 aa, Staphylococcus aureus; identical to SEQ ID NO: 30390
  subsp. aureus DSM 20231

SEQ ID NO: 38601 - protein, 319 aa, Staphylococcus aureus; identical to SEQ ID NO: 30741
  subsp. aureus DSM 20231

SEQ ID NO: 38602 - protein, 231 aa, Staphylococcus aureus
  subsp. aureus DSM 20231
MKKTLLASSLAVGLGIVAGNAGHEAHASEADLNKASLAQMAQSNDQTLNQKPIEAGAYNYTFDYEGFTYHFESDGRHFAWNYHATGTNGADMSAQAPATNNVAPSAVQANQVQSQEVEAPQNAQTQQPQASTSNNSQVTATPTESKSSEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 38603 - protein, 372 aa, Staphylococcus aureus; identical to SEQ ID NO: 31084
  subsp. aureus DSM 20231

SEQ ID NO: 38604 - protein, 350 aa, Staphylococcus aureus; identical to SEQ ID NO: 30602
  subsp. aureus DSM 20231

SEQ ID NO: 38605 - protein, 241 aa, Staphylococcus aureus; identical to SEQ ID NO: 30738
  subsp. aureus DSM 20231

SEQ ID NO: 38606 - protein, 330 aa, Staphylococcus aureus; identical to SEQ ID NO: 30381
  subsp. aureus DSM 20231

SEQ ID NO: 38607 - protein, 1369 aa, Staphylococcus aureus; identical to SEQ ID NO: 37923
  subsp. aureus DSM 20231

SEQ ID NO: 38608 - protein, 306 aa, Staphylococcus aureus; identical to SEQ ID NO: 30803
  subsp. aureus DSM 20231

SEQ ID NO: 38609 - protein, 165 aa, Staphylococcus aureus; identical to SEQ ID NO: 30742
  subsp. aureus DSM 20231

SEQ ID NO: 38610 - protein, 995 aa, Staphylococcus aureus; identical to SEQ ID NO: 31752
  subsp. aureus DSM 20231

SEQ ID NO: 38611 - protein, 645 aa, Staphylococcus aureus; identical to SEQ ID NO: 30747
  subsp. aureus DSM 20231

SEQ ID NO: 38612 - protein, 241 aa, Staphylococcus aureus; identical to SEQ ID NO: 30739
  subsp. aureus DSM 20231

SEQ ID NO: 38613 - protein, 250 aa, Staphylococcus aureus; identical to SEQ ID NO: 31910
  subsp. aureus DSM 20231

SEQ ID NO: 38614 - protein, 1166 aa, Staphylococcus aureus
  subsp. aureus DSM 20231
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 38615 - protein, 109 aa, Staphylococcus aureus; identical to SEQ ID NO: 30744
  subsp. aureus DSM 20231

SEQ ID NO: 38616 - protein, 238 aa, Staphylococcus aureus; identical to SEQ ID NO: 30740
  subsp. aureus DSM 20231

SEQ ID NO: 38617 - protein, 810 aa, Staphylococcus aureus; identical to SEQ ID NO: 35888
  subsp. aureus E1410

SEQ ID NO: 38618 - protein, 141 aa, Staphylococcus aureus; identical to SEQ ID NO: 31214
  subsp. aureus E1410

SEQ ID NO: 38619 - protein, 321 aa, Staphylococcus aureus; identical to SEQ ID NO: 31900
  subsp. aureus E1410

SEQ ID NO: 38620 - protein, 315 aa, Staphylococcus aureus; identical to SEQ ID NO: 31191
  subsp. aureus E1410

SEQ ID NO: 38621 - protein, 325 aa, Staphylococcus aureus; identical to SEQ ID NO: 30479
  subsp. aureus E1410

SEQ ID NO: 38622 - protein, 105 aa, Staphylococcus aureus; identical to SEQ ID NO: 36266
  subsp. aureus E1410

SEQ ID NO: 38623 - protein, 770 aa, Staphylococcus aureus
  subsp. aureus E1410
MKSNLRYGIRKHKLGAASVFLGTMIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQ

SEQ ID NO: 38624 - protein, 1019 aa, Staphylococcus aureus; identical to SEQ ID NO: 35818
  subsp. aureus E1410

SEQ ID NO: 38625 - protein, 233 aa, Staphylococcus aureus; identical to SEQ ID NO: 31039
  subsp. aureus E1410

SEQ ID NO: 38626 - protein, 927 aa, Staphylococcus aureus
  subsp. aureus E1410
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 38627 - protein, 1731 aa, Staphylococcus aureus; identical to SEQ ID NO: 35821
  subsp. aureus E1410

SEQ ID NO: 38628 - protein, 681 aa, Staphylococcus aureus; identical to SEQ ID NO: 31046
  subsp. aureus E1410

SEQ ID NO: 38629 - protein, 102 aa, Staphylococcus aureus; identical to SEQ ID NO: 36213
  subsp. aureus E1410

SEQ ID NO: 38630 - protein, 582 aa, Staphylococcus aureus; identical to SEQ ID NO: 35824
  subsp. aureus E1410

SEQ ID NO: 38631 - protein, 454 aa, Staphylococcus aureus
  subsp. aureus E1410
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38632 - protein, 221 aa, Staphylococcus aureus; identical to SEQ ID NO: 31036
  subsp. aureus E1410

SEQ ID NO: 38633 - protein, 645 aa, Staphylococcus aureus; identical to SEQ ID NO: 35633
  subsp. aureus E1410

SEQ ID NO: 38634 - protein, 226 aa, Staphylococcus aureus; identical to SEQ ID NO: 31265
  subsp. aureus E1410

SEQ ID NO: 38635 - protein, 231 aa, Staphylococcus aureus; identical to SEQ ID NO: 35706
  subsp. aureus E1410

SEQ ID NO: 38636 - protein, 343 aa, Staphylococcus aureus; identical to SEQ ID NO: 31263
  subsp. aureus E1410

SEQ ID NO: 38637 - protein, 304 aa, Staphylococcus aureus; identical to SEQ ID NO: 35708
  subsp. aureus E1410

SEQ ID NO: 38638 - protein, 234 aa, Staphylococcus aureus
  subsp. aureus E1410
MKMTAIAKASLALSILATGIITSTAQTVNASEHESKYENVTKDIFDLRDYYSRASKELKNVTGYRYSKGGKHYLIFDKNRKFTRIQIFGKDIERIKKRKNPGLDIFVVKEAENRNGTVYSYGGVTKKNQGAYYDYLSAPRFVIKKEVGAGVSVHVKRYYIYKEEISLKELDFKLRQYLIQDFDLYKKFPKASKIKVTMKDGGYYTFELNKKLQTNRMSDVIDGRNIEKIEANIR

SEQ ID NO: 38639 - protein, 231 aa, Staphylococcus aureus; identical to SEQ ID NO: 30566
  subsp. aureus E1410

SEQ ID NO: 38640 - protein, 232 aa, Staphylococcus aureus; identical to SEQ ID NO: 30565
  subsp. aureus E1410

SEQ ID NO: 38641 - protein, 227 aa, Staphylococcus aureus; identical to SEQ ID NO: 30564
  subsp. aureus E1410

SEQ ID NO: 38642 - protein, 232 aa, Staphylococcus aureus; identical to SEQ ID NO: 31257
  subsp. aureus E1410

SEQ ID NO: 38643 - protein, 954 aa, Staphylococcus aureus
  subsp. aureus E1410
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYDNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSESDSDSESDSDSDSDSDSDSDSDSDSDSDSESDSDSDSDSDSDSDSDSDSDSDSDSDSDSDSDSDSDSDSDSDSESDSDSDSDSESDSDSDSDSESDSDSDSDSDSDSDSESDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 38644 - protein, 1037 aa, Staphylococcus aureus
  subsp. aureus E1410
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIESNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLN

SEQ ID NO: 38645 - protein, 54 aa, Staphylococcus aureus; identical to SEQ ID NO: 35777
  subsp. aureus E1410

SEQ ID NO: 38646 - protein, 858 aa, Staphylococcus aureus; identical to SEQ ID NO: 35718
  subsp. aureus E1410

SEQ ID NO: 38647 - protein, 51 aa, Staphylococcus aureus; identical to SEQ ID NO: 35980
  subsp. aureus E1410

SEQ ID NO: 38648 - protein, 434 aa, Staphylococcus aureus [sequence omitted]

SEQ ID NO: 38649 - protein, 1005 aa, Staphylococcus aureus; identical to SEQ ID NO: 35721
  subsp. aureus E1410

SEQ ID NO: 38650 - protein, 151 aa, Staphylococcus aureus; identical to SEQ ID NO: 35733
  subsp. aureus E1410

SEQ ID NO: 38651 - protein, 291 aa, Staphylococcus aureus; identical to SEQ ID NO: 30390
  subsp. aureus E1410

SEQ ID NO: 38652 - protein, 890 aa, Staphylococcus aureus; identical to SEQ ID NO: 35735
  subsp. aureus E1410

SEQ ID NO: 38653 - protein, 2035 aa, Staphylococcus aureus; identical to SEQ ID NO: 35736
  subsp. aureus E1410

SEQ ID NO: 38654 - protein, 331 aa, Staphylococcus aureus; identical to SEQ ID NO: 31235
  subsp. aureus E1410

SEQ ID NO: 38655 - protein, 674 aa, Staphylococcus aureus
  subsp. aureus E1410
MSMTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAEAMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKKVILVSGVKLIKVKKKMTKKMSIMK

SEQ ID NO: 38656 - protein, 258 aa, Staphylococcus aureus; identical to SEQ ID NO: 30518
  subsp. aureus E1410

SEQ ID NO: 38657 - protein, 251 aa, Staphylococcus aureus; identical to SEQ ID NO: 30505
  subsp. aureus E1410

SEQ ID NO: 38658 - protein, 261 aa, Staphylococcus aureus; identical to SEQ ID NO: 30506
  subsp. aureus E1410

SEQ ID NO: 38659 - protein, 242 aa, Staphylococcus aureus; identical to SEQ ID NO: 30522
  subsp. aureus E1410

SEQ ID NO: 38660 - protein, 239 aa, Staphylococcus aureus; identical to SEQ ID NO: 35743
  subsp. aureus E1410

SEQ ID NO: 38661 - protein, 254 aa, Staphylococcus aureus; identical to SEQ ID NO: 31226
  subsp. aureus E1410

SEQ ID NO: 38662 - protein, 645 aa, Staphylococcus aureus
  subsp. aureus E1410
MNKQQKEFKSFYSIRKSSLGVASVAISTLLLLMSNGEAKAAEETGVTNTEAQPKTEAVASPTTTTTEKAPEAKPVANAVSVSNKEVVAPTTETKEVKAVKEVKAPKEAKEEKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKTNKKEQQDNSAKKETTPAMPSKPTTPPVEKESQKQDSQKDDNKQSPSVEKENDASSESGKDKMPVTKPAKAEVESSSTTPTKVVSTTQNVAKPTTASSETTKDVVQTSAGSSEAKDSAPLQKANIKNTNDGHTQSQNNKNTQENKAKSLPQTGEESNKDMTLPLMALIALSSIVAFVLPRKRKN

SEQ ID NO: 38663 - protein, 354 aa, Staphylococcus aureus; identical to SEQ ID NO: 30412
  subsp. aureus E1410

SEQ ID NO: 38664 - protein, 105 aa, Staphylococcus aureus; identical to SEQ ID NO: 31168
  subsp. aureus E1410

SEQ ID NO: 38665 - protein, 165 aa, Staphylococcus aureus; identical to SEQ ID NO: 31241
  subsp. aureus E1410

SEQ ID NO: 38666 - protein, 319 aa, Staphylococcus aureus; identical to SEQ ID NO: 33985
  subsp. aureus E1410

SEQ ID NO: 38667 - protein, 238 aa, Staphylococcus aureus; identical to SEQ ID NO: 31240
  subsp. aureus E1410

SEQ ID NO: 38668 - protein, 241 aa, Staphylococcus aureus; identical to SEQ ID NO: 31239
  subsp. aureus E1410

SEQ ID NO: 38669 - protein, 241 aa, Staphylococcus aureus; identical to SEQ ID NO: 31173
  subsp. aureus E1410

SEQ ID NO: 38670 - protein, 176 aa, Staphylococcus aureus; identical to SEQ ID NO: 35732
  subsp. aureus E1410

SEQ ID NO: 38671 - protein, 689 aa, Staphylococcus aureus; identical to SEQ ID NO: 31861
  subsp. aureus E1410

SEQ ID NO: 38672 - protein, 274 aa, Staphylococcus aureus; identical to SEQ ID NO: 33993
  subsp. aureus E1410

SEQ ID NO: 38673 - protein, 339 aa, Staphylococcus aureus
  subsp. aureus E1410
MIKQVCKNITICSLALSTALTVFPASSYAEIKSKITTVSEKNLDGDTKMYTRTATTSDTEKKISQSLQFNFLTEPNYDKETVFIKAKGTIGSGLKILNPNGYWNSTLTWPGSYSVSIQNVDDNNNSTNVTDFAPKNQDESREVKYTYGYKTGGDFSINRGGLTGNITKEKNYSETISYQQPSYRTLIDQPTTNKGVAWKVEAHSINNMGHDHTRQLTNDSDDRVKSEIFSLTRNGNLWAKDNFTPKNKMPVTVSEGFNPEFLAVMSHDKNDKGKSRFIVHYKRSMDDFKLDWNKHGFWGYWSGENHVDQKEEKLSALYEVDWKTHDVKLIKTINDKEQK

SEQ ID NO: 38674 - protein, 351 aa, Staphylococcus aureus; identical to SEQ ID NO: 33991
  subsp. aureus E1410

SEQ ID NO: 38675 - protein, 231 aa, Staphylococcus aureus; identical to SEQ ID NO: 31216
  subsp. aureus E1410

SEQ ID NO: 38676 - protein, 40 aa, Staphylococcus aureus; identical to SEQ ID NO: 31854
  subsp. aureus E1410

SEQ ID NO: 38677 - protein, 516 aa, Staphylococcus aureus; identical to SEQ ID NO: 31270
  subsp. aureus EMRSA16

SEQ ID NO: 38678 - protein, 221 aa, Staphylococcus aureus; identical to SEQ ID NO: 31036
  subsp. aureus EMRSA16

SEQ ID NO: 38679 - protein, 691 aa, Staphylococcus aureus; identical to SEQ ID NO: 31040
  subsp. aureus EMRSA16

SEQ ID NO: 38680 - protein, 226 aa, Staphylococcus aureus; identical to SEQ ID NO: 31265
  subsp. aureus EMRSA16

SEQ ID NO: 38681 - protein, 231 aa, Staphylococcus aureus; identical to SEQ ID NO: 35706
  subsp. aureus EMRSA16

SEQ ID NO: 38682 - protein, 343 aa, Staphylococcus aureus; identical to SEQ ID NO: 31263
  subsp. aureus EMRSA16

SEQ ID NO: 38683 - protein, 304 aa, Staphylococcus aureus
  subsp. aureus EMRSA16
MTQIAKTSLALSLLTTGASIVTTQSANAEVASALKTEQAIKSKIQKVTTSPSPNVQPQSPQPTPSVTTPPSPNVQPQSPQPTPNPTTPHSSNVETKQPQSPTTKQAQKEINPKYKDLRTYYTKPSLEFEKQFGFMLKPWTTVRFMNVIPDWFIYKIALVGKDDKKYKDGPYDNIDVFIVLEDNKYQLKKYSVGGITKTNSKKVDHKAELSITKKDEKGKISHDDSEYKITKEEISLKELDFKLRKQLIEQHNLYGNIGSGTIVIKTKNGGKYTFELHKKLQEHRMADVIDGTSIERIEVNLKSS

SEQ ID NO: 38684 - protein, 239 aa, Staphylococcus aureus
  subsp. aureus EMRSA16
MEHTTMKMTAIAKASLALSILATGVITSTAQTVNASEHESKYENVTKDIFDLRDYYSRASKELKNVTGYRYSKGGKHYLIFDKNRKFTRIQIFGKDIERIKKRKNPGLDIFVVKEAENRNGTVYSYGGVTKKNQGAYYDYLSAPRFVIKKEVGAGVSVHVKRYYIYKEEISLKELDFKLRQYLIQDFDLYKKFPKASKIKVTMKDGGYYTFELNKKLQTNRMSDVIDGRNIEKIEANIR

SEQ ID NO: 38685 - protein, 231 aa, Staphylococcus aureus; identical to SEQ ID NO: 30566
  subsp. aureus EMRSA16

SEQ ID NO: 38686 - protein, 232 aa, Staphylococcus aureus; identical to SEQ ID NO: 30565
  subsp. aureus EMRSA16

SEQ ID NO: 38687 - protein, 227 aa, Staphylococcus aureus; identical to SEQ ID NO: 30564
  subsp. aureus EMRSA16

SEQ ID NO: 38688 - protein, 232 aa, Staphylococcus aureus; identical to SEQ ID NO: 31257
  subsp. aureus EMRSA16

SEQ ID NO: 38689 - protein, 753 aa, Staphylococcus aureus
  subsp. aureus EMRSA16
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDERF

SEQ ID NO: 38690 - protein, 54 aa, Staphylococcus aureus; identical to SEQ ID NO: 35777
  subsp. aureus EMRSA16

SEQ ID NO: 38691 - protein, 1374 aa, Staphylococcus aureus; identical to SEQ ID NO: 36154
  subsp. aureus EMRSA16

SEQ ID NO: 38692 - protein, 1042 aa, Staphylococcus aureus
  subsp. aureus EMRSA16
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 38693 - protein, 434 aa, Staphylococcus aureus [sequence omitted]

SEQ ID NO: 38694 - protein, 62 aa, Staphylococcus aureus; identical to SEQ ID NO: 35782
  subsp. aureus EMRSA16

SEQ ID NO: 38695 - protein, 652 aa, Staphylococcus aureus; identical to SEQ ID NO: 34746
  subsp. aureus EMRSA16

SEQ ID NO: 38696 - protein, 354 aa, Staphylococcus aureus; identical to SEQ ID NO: 30412
  subsp. aureus EMRSA16

SEQ ID NO: 38697 - protein, 109 aa, Staphylococcus aureus; identical to SEQ ID NO: 35948
  subsp. aureus EMRSA16

SEQ ID NO: 38698 - protein, 165 aa, Staphylococcus aureus
  subsp. aureus EMRSA16
MKNKLIAKSLLAIAAIGITTTTIASTADASEGYGPREKKPVSINHNIVEYNDGTFKYQSGPKFNTTPKYIKFRHDYNIVEYNDGTFEYGARPQFNKPAAKTEATIKKEQKLIQAQNLVREFEKTHTVSAHRKAQKAVNLVSFEYNVKKMILQERIDQVLKQGLVR

SEQ ID NO: 38699 - protein, 206 aa, Staphylococcus aureus; identical to SEQ ID NO: 34750
  subsp. aureus EMRSA16

SEQ ID NO: 38700 - protein, 115 aa, Staphylococcus aureus
  subsp. aureus EMRSA16
MMKMKTRIVSSVTTTLLLGSILMNPVANAADSDINIKTGTTDIGSNTTVKTGDLVTYDKENGMHKKVFYSFIDDKNHNKKILVIRTKGTIAGQYRVYSEEGANKSGLAWPSAFKV

SEQ ID NO: 38701 - protein, 247 aa, Staphylococcus aureus; identical to SEQ ID NO: 31904
  subsp. aureus EMRSA16

SEQ ID NO: 38702 - protein, 273 aa, Staphylococcus aureus
  subsp. aureus EMRSA16
MNTNRLNDLIDFSLFINLLFLAYNIPRKGDFLMKNNLTKKIILSIALTMIGTATSQSPHSPISMSSEAKAYNISESETNVNELTKYYTQRHLTFSNKWLWQKDNGTIHATLLQLSWFSHIQVFGPESWGNINQLRNKYVDIFALKDYETWRTYMLAQETFTGGVTPVAKPSDKHYKLNVTYKDKAGTFIGEYQFYTGNKPVLTLKEVDFRIRQTLIKNKKLYNGDYNKGHIKITGGSNNYTIDLSKRLKSTDANRYVKNPQTAHIEILLEKSS

SEQ ID NO: 38703 - protein, 251 aa, Staphylococcus aureus
  subsp. aureus EMRSA16
MGNSRKGDYHMKKNITNKIVLSTALLLLGTTSTQPPKAPISFSSEAKAYNISENETNINELIKYYTQPHLSFSGKWLWQNPNGTIHATLQTWVWYTHIQVFGPESWGNINQLRDKYVDIFGTKDEDTIEGYWTYDETFTGGVTPAATSSDKPYKLFLKYKDKQQTMIGGLEFYQGNKPVITLKELDFRVRQTLIKNKKLYNGEFNKGQIRITGGGNHYTIDLSKKLKLTDTNSYVKNPRHAEIEVILEKSH

SEQ ID NO: 38704 - protein, 428 aa, Staphylococcus aureus
  subsp. aureus EMRSA16
MGYLSCDEFKYTFHILKRQVNYFTSFNSFLKQSKFLLKYIVHYVIIFIYYCKECFVMNKQQSKVRYSIRKVSIGILSISIGMFLALGMSNKAYADEIDKSKDFTRGYEQNVFAKSELNANKNTTKDKIKNEAVVKTSDTSLKLDNKSAISNGNEINQDMKISNTPKNSNQGNNLVVNNNEPTKEIKIANLEAQNSNQKKVNKGTNNYFGYYSFREAPKTQIYTVKKGDTLSAIALKYKTTVSNIQNTNNIANPNLIFIGQKLKVPMTPLVEPKPKTVPSNNKSNSNNSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 38705 - protein, 270 aa, Staphylococcus aureus; identical to SEQ ID NO: 35140
  subsp. aureus EMRSA16

SEQ ID NO: 38706 - protein, 278 aa, Staphylococcus aureus; identical to SEQ ID NO: 34714
  subsp. aureus EMRSA16

SEQ ID NO: 38707 - protein, 2189 aa, Staphylococcus aureus; identical to SEQ ID NO: 31236
  subsp. aureus EMRSA16

SEQ ID NO: 38708 - protein, 350 aa, Staphylococcus aureus
  subsp. aureus EMRSA16
MYLALCTNHIVNNEGDFLGMSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVSYEASATTPATTSSADTDSEDSEKSSKDEDKQNASKSDNSSVEKSESNEETAPVEPMPHSKPTTSEAPPSQNIHNEDSMYDASTE

SEQ ID NO: 38709 - protein, 808 aa, Staphylococcus aureus; identical to SEQ ID NO: 35997
  subsp. aureus EMRSA16

SEQ ID NO: 38710 - protein, 258 aa, Staphylococcus aureus; identical to SEQ ID NO: 30518
  subsp. aureus EMRSA16

SEQ ID NO: 38711 - protein, 251 aa, Staphylococcus aureus; identical to SEQ ID NO: 30505
  subsp. aureus EMRSA16

SEQ ID NO: 38712 - protein, 261 aa, Staphylococcus aureus; identical to SEQ ID NO: 30506
  subsp. aureus EMRSA16

SEQ ID NO: 38713 - protein, 242 aa, Staphylococcus aureus; identical to SEQ ID NO: 30522
  subsp. aureus EMRSA16

SEQ ID NO: 38714 - protein, 239 aa, Staphylococcus aureus; identical to SEQ ID NO: 30171
  subsp. aureus EMRSA16

SEQ ID NO: 38715 - protein, 254 aa, Staphylococcus aureus
  subsp. aureus EMRSA16
MLNVLLLIINLIAICSVNNAYANEENPKIEDLCKKSSVDDIALHNIDKDYMTNRFTINESTVLTTEKFLDIDLLFKNFTWLDGKSAEFKDLKVEFSSSEISKEYFGKTVDIYGVYYKAHCHGEHQVKTACTYGGVTPHENNKLSEPKEIGVAVYKDNVNVNTFIVTTDKKKVTAQELDIKVRTKLNNVYKLYDRMTSDVQKGYIKFHSHSEHKESFYYDLFCIKGNLPDQYLQIYNDNKTIDSSDYHIDVYLFT

SEQ ID NO: 38716 - protein, 689 aa, Staphylococcus aureus; identical to SEQ ID NO: 31224
  subsp. aureus EMRSA16

SEQ ID NO: 38717 - protein, 257 aa, Staphylococcus aureus; identical to SEQ ID NO: 31220
  subsp. aureus EMRSA16

SEQ ID NO: 38718 - protein, 231 aa, Staphylococcus aureus; identical to SEQ ID NO: 36931
  subsp. aureus EMRSA16

SEQ ID NO: 38719 - protein, 339 aa, Staphylococcus aureus; identical to SEQ ID NO: 31219
  subsp. aureus EMRSA16

SEQ ID NO: 38720 - protein, 351 aa, Staphylococcus aureus; identical to SEQ ID NO: 31218
  subsp. aureus EMRSA16

SEQ ID NO: 38721 - protein, 234 aa, Staphylococcus aureus; identical to SEQ ID NO: 30530
  subsp. aureus EMRSA16

SEQ ID NO: 38722 - protein, 231 aa, Staphylococcus aureus; identical to SEQ ID NO: 31216
  subsp. aureus EMRSA16

SEQ ID NO: 38723 - protein, 810 aa, Staphylococcus aureus; identical to SEQ ID NO: 35888
  subsp. aureus EMRSA16

SEQ ID NO: 38724 - protein, 141 aa, Staphylococcus aureus; identical to SEQ ID NO: 31214
  subsp. aureus EMRSA16

SEQ ID NO: 38725 - protein, 321 aa, Staphylococcus aureus; identical to SEQ ID NO: 31900
  subsp. aureus EMRSA16

SEQ ID NO: 38726 - protein, 318 aa, Staphylococcus aureus
  subsp. aureus EMRSA16
MKIMLKNKILATTLSVSLLAPLANPLLENAKAANDTEDIGKGNDVEIIKRTEDKTSNKWGVTQNIQFDFVKDKKYNKDALILKMQGFISSRTTYYNYKNTNHIKSMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFKNRNYTVKYEVNWKTHEIKVKGQN

SEQ ID NO: 38727 - protein, 325 aa, Staphylococcus aureus; identical to SEQ ID NO: 30479
  subsp. aureus EMRSA16

SEQ ID NO: 38728 - protein, 965 aa, Staphylococcus aureus; identical to SEQ ID NO: 36397
  subsp. aureus EMRSA16

SEQ ID NO: 38729 - protein, 233 aa, Staphylococcus aureus; identical to SEQ ID NO: 31039
  subsp. aureus EMRSA16

SEQ ID NO: 38730 - protein, 873 aa, Staphylococcus aureus; identical to SEQ ID NO: 31205
  subsp. aureus EMRSA16

SEQ ID NO: 38731 - protein, 1351 aa, Staphylococcus aureus; identical to SEQ ID NO: 31203
  subsp. aureus EMRSA16

SEQ ID NO: 38732 - protein, 680 aa, Staphylococcus aureus; identical to SEQ ID NO: 31201
  subsp. aureus EMRSA16

SEQ ID NO: 38733 - protein, 639 aa, Staphylococcus aureus
  subsp. aureus H19
MTYRMKKWQKLSTITLLMAGVIILNGGEFRSIDKHQIAVANTNVQTPDYEKLRNTWLDVNYGYDKYDESNDAMKKKFDATESEAKNLLSSMKTESGRTYLWDSAKDLDNKSADMTRTYRNIEKIAEAMKHKDTKLKTDENKKKVKDALDWLHENAYGKEPDKKVKELTSNFKNKTSRNTNLNWWDYEIGTPRALTNTLILLNDQFSNEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFKDSNQNDTTLKSWIDDGFMPLIYKGEMMDLSRGRAISRENETSHSASATVMKSLLRLSDAMDDSTKAKYKQIVKNSVKSDSSYDQNDTLSSYSDISKMKSLMEDSTISTNGLTQQLKIYNDMDRVTYHNKDLDFAFGLSMTSKNVARYESINNENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTASSKNPVTTIENRKANGYTMYTDDKQTTASDNQETNSVFLESTDNKKEHRLSIF

SEQ ID NO: 38734 - protein, 141 aa, Staphylococcus aureus; identical to SEQ ID NO: 31189
  subsp. aureus H19

SEQ ID NO: 38735 - protein, 321 aa, Staphylococcus aureus; identical to SEQ ID NO: 30959
  subsp. aureus H19

SEQ ID NO: 38736 - protein, 315 aa, Staphylococcus aureus; identical to SEQ ID NO: 38494
  subsp. aureus H19

SEQ ID NO: 38737 - protein, 325 aa, Staphylococcus aureus; identical to SEQ ID NO: 38495
  subsp. aureus H19

SEQ ID NO: 38738 - protein, 986 aa, Staphylococcus aureus
  subsp. aureus H19
MIVVGMGQDKEAAASEQKTTTVEENGNSATDNKVNATQTTTTNVNHIEETQPYNATVTEQPSNATQVTTEEAPKAAVQAPQTAQPANVETVKEEVVKEEAKPQVKETTQSQDNSGDQRQVDLTPKKATQNQAAETQVEVAQPRTVSESKPRVTRSADVVEASDVSEVKGTDVTSKVTVTESSIEGHNNTNKVEPHEGQRAILKYKLKFENGLHQGDFFDFTLSKNVNTHGVSTARKVPDIKNGSVVMATGKILEDGKIRYTFTNDVEHKVEVTANLEINLFIDPKTFQSNGEEKVTSSLNGSKTEKNLKIEYKNGVGTYYANVNGSIETFDKEKNKFTHVAYVKPLNQFKLGTVTVSGTVTQGSNPNGEKPTVKIYEVTNDGKDLPQSVYLDASDKNKYKDVTNEMQSKLTVQENGNYTLNLDTLDKSYVIHYSGEYLNGTNEVNFRTQMFGYPEQRYGYYYNSYQLTWDNGLVLYSNKADGNGKNGQIIQNNDFEYKEDTLTETVTGQYDEKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNNGNQSFEEDTEEDKPKYEQGGNIVDIDFDSVPQIQGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPAPEVPSEPDTPAPPTPEVPSEPGEPTPPTPEVPSEPDTPTPPTPEVPTEPGKPVPPAKEEPKKPSKPVERGKVVTPVIEINEKVKAVAPTKQKQSKKSELPETGGEESTNKGMLFGGLFSILGLALLRRNKKNHKV

SEQ ID NO: 38739 - protein, 233 aa, Staphylococcus aureus; identical to SEQ ID NO: 31111
  subsp. aureus H19

SEQ ID NO: 38740 - protein, 214 aa, Staphylococcus aureus; identical to SEQ ID NO: 38498
  subsp. aureus H19

SEQ ID NO: 38741 - protein, 793 aa, Staphylococcus aureus
  subsp. aureus H19
MKKRIDYLSNKQNKYSIRRFTVGTTSVIVGATILFGIGNHQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSEPSVRTRAVRSLAVAEPVVNAADAKGTNVNDKVTASDFKLEKTTFDPNQSGNTFMAANFKVAGKVKSGDYFTAKLPDSVTGNGDVDYSNSNNTMPIADIVNDKKEVVAKATYDILTKTYTFVFTDYVNDKENINGQFSLPLFTDRAKAPKSGTYDANINIADEMFNNQITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPDPEPEPTPDPEPSPDPDPEPTPDPEPSPEPDPDSDSDSDSGSDSDSGSDSDSDSDSDSDSDSDSDSDSDSDSDSDSESDSDSDSDSDSDSDSDSDSDSDSESDSDSDSDSDSDSDSESDSDSDSDSDSDSDSDSDSDSDSESDSDSDSDSRVTPPNNEQKAPSNPKGEVNHSNKASKQHQTDALPETGDKSENTNATLFGAMMALLGSLLLFRKRKQDHKEKA

SEQ ID NO: 38742 - protein, 2281 aa, Staphylococcus aureus
  subsp. aureus H19
MSKRQKEFHDSLANEKTRVRLYKSGKNWVKSGIKEIEMFKIMGLPFISHSIVSQDNQSISKKMTGYGLKTTAVIGGAFTINMLHDQQAFAASDAPLTSELNTQSETVGNQNSTTIEASTSTADSTSVTKNSSSEQTSNSDTVSSEKSENVTSTTNSTSNQQEKLTSTSESTSSKNTTSSSDTKSVASTSSTEQQTNISTNQSTASNTTSQSTAPASTHLKQTSTTSTSTAPVKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSSVAGGGAFGAFVTTDSTGVATTYTSSSTADNAAKLKVQPTNNTFQNFDITYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIMTSTSVSTSKSTSTSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSNSTSNSISTSESLSESVSTSESISISNSISNSVSASTSKSDSQSTSISLSTSDSKSMSTSESLSDSTSTSDSVSGSLSVAGSQSVSTSTSDSMSTSEMISDSMSTSGSLAASDSKSMSVSSSMSTSQSGSTSESLSDSQSTSDSDSKSLSLSTSQSGSTSTSTSTSSSVRMSESQSTSGSMSTSQSDSTSISTSFSDSTSDSKSASTASSESISQSVSTSTSDSMSTSTSLSTSNSERTSTSLSDSTSLSTSESDSTSDSTSTSDSISEAISGSESTSISLSESNSTSDSESKSASAFLSESLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSESKSDSTSMSLSMSQSTSGSTSVSTSESLSDSTSTSLSLSASMNQSGVDSNSASQSASTSTSTSTSESDSQSTSSYTSQSTSQSESTSTSTSLSDSTSMSRSTSQSGSTSTSESLSGSESESDSQSISTSTSESKSESTSTSLSDSTSISNSGSASTSTSLSNSASASESDSSSTSLSDSTSASMQSSESDSQSTSTSLSNSQSTSTSIRMSTIASESVSESTSESGSTSESTSESDSTSTSLSDSQSTSRSTSASGSASTSTSTSDSRSTSASTSTSMRTSTSDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSTSLSDSKSLSSSQSMSGSESTSTSVSDSQSSSTSNSQFDSMSISASESDSMSTSDSSSISGSNSTSTSLSTSDSMSGSVSVSTSTSLSDSISGSISVSDSSSTSTSESLSDSMAQSQSTSTSASGSLSTSISSSMSASASTSTSQSTSVSTSLSTSDSISDSTSISISGSQSAVESESTSDSTSISDSESLSTSGSDSTSTSTSDSTSTSLSLSTSGSISGSTSTSASGSLSMSNSGSTSVSDSTSMSESNSASISMSQSISGSTSGSTSISTSESLSMSGSTHNSTSVSDSDSVSMSNSTSTSMSDSTSVSDSESVSTSASTSLSTSDSTSTSESLSASMSGSQSISDSTSTSMSNSMSMSTSESNSMHPSDSMSMHHTHSTSTSISTSEATTSTSESQSTLSATSEATKHNGTRAQSEERLPDTGDSIKQNGLLGGVMTLLVGLGLMKRKKKKDENEQDDSQA

SEQ ID NO: 38743 - protein, 681 aa, Staphylococcus aureus; identical to SEQ ID NO: 35560
  subsp. aureus H19

SEQ ID NO: 38744 - protein, 246 aa, Staphylococcus aureus; identical to SEQ ID NO: 35517
  subsp. aureus H19

SEQ ID NO: 38745 - protein, 110 aa, Staphylococcus aureus; identical to SEQ ID NO: 36281
  subsp. aureus H19

SEQ ID NO: 38746 - protein, 465 aa, Staphylococcus aureus
  subsp. aureus H19
MKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEEQRNGFIQSLKDDPSQSTNVLGEAKKLNESQAPKADNNFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNKPGKEDGNKPGKEDGNKPGKEDNNKPGKEDGNKPGKEDNKKPGKEDGNKPGKEDNNKPGKEDGNKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38747 - protein, 691 aa, Staphylococcus aureus; identical to SEQ ID NO: 38448
  subsp. aureus H19

SEQ ID NO: 38748 - protein, 203 aa, Staphylococcus aureus; identical to SEQ ID NO: 38450
  subsp. aureus H19

SEQ ID NO: 38749 - protein, 271 aa, Staphylococcus aureus
  subsp. aureus H19
MKEIKMNKSRFISCVILIFALILVLFTPNVLAESQPDPTPDELHKASKFTGLMENMKVLYDDHYVSATKVKSVDKFLAHDLIYNISDKKLKNYDKVKTELLNEGLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKSVKIEVHLTTKNG

SEQ ID NO: 38750 - protein, 240 aa, Staphylococcus aureus
  subsp. aureus H19
MKKRLLFVIVITLFIFSSNHTVLSNGDVGPGNLRNFYTKYEYVNLKNVKDKNSPESHRLEYSYKNDTLYAEFDNEYITSDLKGKNVDVFGISYKYGSNSRTIYGGVTKAENNKLDSPRIIPINLIINGKHQTVTTKSVSTDKKMVTAQEIDVKLRKYLQDEFNIYGHNDTGKGKEYGTSSKFYSGFDKGSVVFHMNDGSNFSYDLFYTGYGLPESFLKIYKDNKTVDSTQFHLDVEIPKR

SEQ ID NO: 38751 - protein, 226 aa, Staphylococcus aureus; identical to SEQ ID NO: 38451
  subsp. aureus H19

SEQ ID NO: 38752 - protein, 231 aa, Staphylococcus aureus; identical to SEQ ID NO: 38452
  subsp. aureus H19

SEQ ID NO: 38753 - protein, 173 aa, Staphylococcus aureus
  subsp. aureus H19
MGIIIKKWTTIRFMNIVPDYFIYKIALVGKDDKKYGEGVHRHVDVFIVLEQNKYGVDKYSVGGITKANRKKVDYKAGISITKEDKKGTISHDVSEYKITKEEISLKELDFKLRKQLIEQHNLYGNIGSGTIVIKMKNGGKYTFELHKKLQQHRMADVIDGTNIDRIEVNLKSS

SEQ ID NO: 38754 - protein, 234 aa, Staphylococcus aureus; identical to SEQ ID NO: 38454
  subsp. aureus H19

SEQ ID NO: 38755 - protein, 231 aa, Staphylococcus aureus; identical to SEQ ID NO: 38455
  subsp. aureus H19

SEQ ID NO: 38756 - protein, 232 aa, Staphylococcus aureus
  subsp. aureus H19
MKLTAIAKATLALGILTTGVMTAESQTVNAKVKLDETQRQYYIYMLKDYYSQESYESTNISVKSEDYYGPNVLNFNQRNKNFKVFLIGDDRNKYKELTHGLDVFAVPELIDTKGGIYSVGGITKKNVRSVFGYVSHPGLLVKKIDPKHGFSINELFFIQKEEVSLKELDFKIRKMLVEKYRLYKGASDKGRIVINMKDERKHEIDLSEKLSFDRMFDVIDSKQIKNIEVNLN

SEQ ID NO: 38757 - protein, 227 aa, Staphylococcus aureus
  subsp. aureus H19
MKFTALAKATLAIGILTTGTLTTEAHSGHAKQIQKSVNKHDKEALHRYYTGNFKEMKNINALRHGKNNLRFKYRGMKTQVLLPGDEYRKYQQRRHTGLDVFFVQERRDKHDISYTVGGVTKTNKTSGFVSTPRLNVTKENGEDAFVKGYPYDIKKEEISLKELDFKLRKHLIEKYGLYKTISKDGRIKISLKDGSFYNLDLRTKLKFKHMGEAIDSKQIKDIEVNLK

SEQ ID NO: 38758 - protein, 230 aa, Staphylococcus aureus; identical to SEQ ID NO: 38458
  subsp. aureus H19

SEQ ID NO: 38759 - protein, 914 aa, Staphylococcus aureus
  subsp. aureus H19
MNNKKTATNRKGMIPNRLNKFSIRKYSVGTASILVGTTLIFGLSGHEAKAAEHTNGELNQSKNETTAPSENKTTEKVDSHQQNNIEQSTTSNQPKVNESDNTSVKETTEEPQNTTSTQPTKQNNDATANKDNLAAQNISTQANDVSATPKTTTIKPRTLNRMAVNTVAAPQQGTNVNDKVHFSNIDIAIDKGHVNTTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETFVSNLTGYKFNPNAKNFKIYEVTDQNQFVDSFTPDTSKLIDVTDKFKITYSNDNKTATVDLLNGQSSSNKQYIIQQVAYPDNSSTDNGKIDYTLETQNGKSSWSNSYSSVNGSSTANGDQKKYNLGDYVWEDTNKDGKQDANEKGIKGVYVILKDSNGKELDRTTTDENGKYQFTGLGNGTYSVEFSTPAGYTPTTANAGTDDAVDSDGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSESDSDSDSDSDSESDSDSDSDSDSESDSDSDSDSDSDSESDSDSESDSDSDSDSDSDSNSDSDSASDSDSDSDSDSDSDRDSDSDSDSDSDSDSDSDSDSDSDSESDSDSDSDSDSDSDSDSESDSDSDSDSESDSDSDAGKHTPVKPMSTTKDHHNKAKALPETGSENNGSNNATLFGGLFAALGSLLLFGRRKKQNK

SEQ ID NO: 38760 - protein, 434 aa, Staphylococcus aureus [sequence omitted]

SEQ ID NO: 38761 - protein, 989 aa, Staphylococcus aureus
  subsp. aureus H19
MNMKKKEKHAIRKKSIGVASVLVGTLIGFGLLSSKEADASENSVTQSDSASNESKSNNPSSVNAAPKTDNTNVSDTKTTSNTNNSETSVAQNPAQQETTQSASTNATTEETPVTGEGTTTATNQANTPAATQSNNTNAEELVNQTSNETTSNDTNTVSSVNSPQNSTNAENVSTTQDTSTEATPSNNESAPQSTDASNKDVVSQAVNPSAPRMRAFSLAAVAADAPAAGTDITNQLTDVTVGIESGDTVYPHQAGYVKLNYGFSVPNSAVKGDTFKITVPKELNLNGVTSTAKVPPIMAGDQVLANGVIDSDGNVIYTFTDYVNTKDDVKATLTVPAYIDPEYVTHTGNVTLATGIGNTTANKTVLVDYEKYGKFYNLSIKGTIDQVDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSTSDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSGSDSDSDSDSESDSDSDSDSDSDSASDSDSGSASDSDSDSDSASDSDSGSDSDSASDSDSDSDSDSDSDSDSDSDSDSDSDSDSDSDSDSDSDSDSDSDSDSASDSDSDSTSDTGSDNDSDSDSNSDFESGSNNNVVPPNSPKNGTNASNKNEAKDSKEPLPDTGSEGEANMSLIWGLLASLGSLLLFRRKKENKDKK

SEQ ID NO: 38762 - protein, 641 aa, Staphylococcus aureus; identical to SEQ ID NO: 38464
  subsp. aureus H19

SEQ ID NO: 38763 - protein, 350 aa, Staphylococcus aureus; identical to SEQ ID NO: 38465
  subsp. aureus H19

SEQ ID NO: 38764 - protein, 105 aa, Staphylococcus aureus; identical to SEQ ID NO: 31168
  subsp. aureus H19

SEQ ID NO: 38765 - protein, 165 aa, Staphylococcus aureus; identical to SEQ ID NO: 38467
  subsp. aureus H19

SEQ ID NO: 38766 - protein, 263 aa, Staphylococcus aureus
  subsp. aureus H19
RKWHAQKIFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMMNQNWGPYDRDSWNPVYGNQLFMKTRNGSMKAAENFLDPNKASSLLSSGFSPDFATVITMDRKASKQQTNIDVIYERVRDDYQLHWTSTNWKGTNTKDKWTDRSSERYKIDWEKEEMTN

SEQ ID NO: 38767 - protein, 238 aa, Staphylococcus aureus
  subsp. aureus H19
MRKSITNKIILTTTLLLLGTTATQTSNSPLNVSTDAKAYYIDQDETNINELIKYYTQKPLTFSNRWLYQYDDGNIYVEFKRYSWSAHIRLWGAESWGNINQLRDRYVDVFGLKDEDTSQLWWVYRDTFTGGVTPAASSSDKPYSLFVQYKDKLQTIIGAHKMYQGNKPILTLKEIDFRAREALIKNKILYHENRNKGKLKITGGGNDYTIDLSKRLHSDLANVYVKNPQKITVEILID

SEQ ID NO: 38768 - protein, 241 aa, Staphylococcus aureus; identical to SEQ ID NO: 38470
  subsp. aureus H19

SEQ ID NO: 38769 - protein, 241 aa, Staphylococcus aureus; identical to SEQ ID NO: 38471
  subsp. aureus H19

SEQ ID NO: 38770 - protein, 3164 aa, Staphylococcus aureus
  subsp. aureus H19
MNYRDKIQKFSIRKYTVGTFSTVIATLVFLGLNTSQAQATETNQPASALKQKQQNGDAQTENRESQVQNSQNSQNGQSLSAPIENEQLNNNQTNHVDASAVQSSTTEHDQPVSQNEQAKKDTTAATPTQSAKAESKHEQNESRSANKKENDNKATHVESHEANVVTASDSSDSGNVQHDRNELQAFFDANYHDYRFIDRENADSGTFNYVKGIFDKINTLLGSNDPINNKDLQLAYKELEQAVALIRTMPQRQQTSRRSSRIQTRSVESRAAEPRSVSSYQNADSSYYVENANDGSGYPVGTYINASNKGAPYNLPTSPWNTLKASAAKEIVLMTAKQTGDGYQWVIKFNKGHAPHENMIFWFALPADQVPVGRTDFVTVNADGTNVQWSNGAGAGANKPLQQMWEYGVNDPDRSHDFKIRNRSGQVIYEWPTVHINSLRDLARAGDYFSEANAPAATKALGEQTFKYINGERPTESPGAPKVYTFIGKGDASYTISFKTQGPTTNKLYYAAGGRALEYNQLFMYSQLYLESTQDYQLRLDGLRQTVNRTYRIGTTKNVEVGQDTYKMKKVLESTNLNIDDFIDDPLSYVRTPSNKVLGFYPTSANPNGRRPGGVQGLNEYQISQLFSDEKLQQAARNRTPIQLMIGFDYPDSHGNAETLVPVNLTVLPEIQHNIKFFKNDDGQNIADKPISKQAGHPVFYVYAGNQGNASVNLGGSVTSIQPLRINLTSNENFTDRDWQITGIPRTLHIENSTNRPNNARERNIELVGNLLPGDYFGTIRFGRKEQLFEIRVKPHTPRITTTAEELRGTALQKAPVTVTGIPLDPSSLVYIVYPNEHTRDGGTEADQIPSGYSILATGTPDGVHNTITIPPEDFTVFIPPVGKQIRALIYYNKVVASNMSNAVTILPDDIPPTINNPVGLNAKYYRGDEVSFTMGVSDRHSGLKSTTITTLPSGWTSNLTKSDKKNGSLAITGRVSMNQAFNSNITFKVAATDNVNNTTNDSQSKHVTVHVGKISEDAHPIVLGNTEKVVVVNPTSVSNDEKQRIITAFMNKNQNIRGYLASTDPVTVDNNGNVTLHYRDGSSTTLDATNVMTYEPVVKSEYQTANAPKTATVTIAKGQSFSIGDIKQYFTLSNGQAIPSGTFTNITSDRTIPTAQEVSQMNAGTQLYHITATNAYHKDTEDFYITLKIIDVKQPEGDQRVYRTSTYDLTTDEISKVKQAFINANRDAITFAEGDISVTNTPNGANVSTVTVNINKGRLTKSFTSNLANMNFLRWVNFPQDYTVSWTNAKIASRPTDGGLSWSDDHKSLIYRYDATLGTAITTNDILTMLKATTTVPGLRNNIVGNEKAQAEAGGRPNYKTTGYSQANPISDGQRQYTLNGQVIQVLDIINPTNGFGGQTITNSNVRANQSNSTVVSVNEPAANGAGAFTINHVVKSNSTHNAADAVYKAQLYLSPYGPKQYVEHLNQNTGNTTDAINIYFVPSDLVNPTISVGNYTNHQVFSGETFTNTITANDNFGVQSVTVPNTSQITGTVDNNHQHVSATAPNVTSATTKTINLVANDTSGNTATTSFNVTVKPLRDKYRVGTSSTAANPVRIANISNNATVSQADQTAIINSLTFTSNAPNRNYATASTNEITSKTVSNVSRTGNNANVTATVTYQDGTTSTVTVPVKHVIPDIVAHSHYTVQGQDFPAGNGSSASDYFKLSNGSAIPDATITWVSGQAPNKDNTCIGEDINVTAHILIDGETTPITKTATYKVVRTVPKHVFETARGVLYPGVSDMYDAKQYVKPVNNSWSTNAQNMNFQFVGTYGPNKDVVGISTRLIRITYDNRQTEELTILSKVKPDPPRIDGNSVTYKAGLTNQEVKVNNVLSNSTVKLFKADNTPLNVTNITYGSGYTSVVTVSDALPNGGIKAKSSISMNNVTYTTQDEHGQVVTVTRNESVDSNDSAAVTVTPQLQATSEGAVFIKGGDGFDFGHVERFIQNPPHGSTVAWHDSPDTWKHTVGNTHKTAVVTLPNGQGTRNVEVPVKVYPVANAKAPSRDLKGQNLTNGTDAMNYITFDPNTNTNGITAAWANRQQPNNQQAGVQQLNVDVTYPGISAAKRVPVTVNVYQFEFPQTTYTTTVGGTLASGTQASGYAHMQNASGLPTDGFTYKWNNAATGTNDANWVAMNKPNAAKVVNAKYDVIYNGHTFATSLPAKFVVKDVQPAKPTVTETAAGAITIAPGANQTVNTHAGNVTTYADKLVIKRNGSVVTTYTRHNNTSPWVKEASAANVTGIAGTNNGITVAAGTFNPADTIQVVATQGSGETISDEQRSDDFTVVAPQPNQATTKIWQNGHIDITPNNPSGHLINPTQAMDIAYTEKVGNGAEHSKTLNAVRGQNNQWTIANKPDYVTLDAQTGKVTFNANTIKPNSAITITPKAGTGHSASSNPSTLTAPATHTVNKTEIVKDYGSNVTPAEINNAVHVAEKRNATIKNGTAMPTNLAGGSTTTIPVTVTYNDGSTEEVQESIFTKADKRELITAKNHLDDPVSTEGKKPGTITQYNNAIHNAQQQINTAKTEAQQVINNERATPQQVSDALTKVRAAQTKIDQAKALLQNKEDNSQLVTSKNNLQSSVNQVPSTAGMTQQSIDNYNAKKREAESEITAAQRIIDNGDATAQQISDEKHRVDNALTALNQAKQNLTADTHALEQAVQQLNRTGTTTGKKPASINAYNNSMHALQAELTSAKNSANAIIQKPIRSVQEVQSALTNVNRVNERLTQAINQLVPLADNSALRTAKTKLDEEINKSVTTDGMTQSSIQAYENAKRAGQTESTNAQNVINNGDATDQQIAAEKTKVEEKYNSLKQAIAGLTPDLAPLQTAKTQLQNDINQPTSTTGMTSASVAAFNDKLSAARTKIQEIDRVLASHPDVATIRQNVTAANAAKSALDQARNGLTVDKAPLENAKNQLQHSIDTQTSTTGMTQDSINAYNAKLTAARNKIQQINQVLAGSPTVDQINTNTSAANQAKSDLDHARQALTPDKAPLQNAKTQLEQSINQPTDTTGMTTASLNAYNQKLQAARQKLTEINQVLNGNPTVQNINDKVNEANQAKDQLNTARQGLTLDRQPALTTLHGASNLNQAQQNNFTQQINAAPNHATLETIKSNITALNTAMNKIKRKCCG

SEQ ID NO: 38771 - protein, 234 aa, Staphylococcus aureus
  subsp. aureus H19
MLEGIFTNSASVIEYSDIHHKSKLNSKRLSNAKMSFINPTQLENKKTNDRLLTHDLLFHDMFLNDASKKDFKVEFENEALSNEFINKNIDIYAGSYSYECHGGETNKTQCSYGGVTLSDNNKYDNDKNIPCNLWIDGHQTEIELTAVKTKKKIVTIQELDVQLRNYLNKKYKLYEQGGDIVKGYVIYHNDDEKNVEYDFYNLNGEYGHEVLKMYADNKTINSDKLHLDIYLFKS

SEQ ID NO: 38772 - protein, 291 aa, Staphylococcus aureus; identical to SEQ ID NO: 30390
  subsp. aureus H19

SEQ ID NO: 38773 - protein, 821 aa, Staphylococcus aureus
  subsp. aureus H19
MNKHQPKLRSFYSIRKSTLGVASVIVSTLFLITSQHQAHAAENTNTSDKISENQNNNATTTQPPKDTNQTQPGTQPANTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGTETNYDYTKLVFAKPIYNDPSLVKSDTNDAVASNDQSSSDASNQTNTNTSNQNASTTNNTSDQPQATTNMSQPAQPKASANSDQASSQPAHETNSNDNTNDATNASSNQSNGNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDTKNNSRTLIFPYVPDKAVYNAIVKVVVANIGYEGQYHVRIINQDIKTKDDDTSQNNTSEHLNGQTVQEDKGTATDTATNNSIETTPSEATDKVDLIEPESDVVKVTDSNIDKDAHHDVDHLSDMSDNTHLDKYDLKEMDTQIAKDTDKGVDNSVGMTSNVDTDKGSNKNEGKVIQLAHNTDKNNHTGKAAKLDGVRQNYNNTDKVTEQKNN

SEQ ID NO: 38774 - protein, 2182 aa, Staphylococcus aureus
  subsp. aureus H19
MNLLKKNKYSIRKYKVGIFSTLIGTVLLLSNPNGAQALTTDHNVQGGSNQALPGNSQNTNADTRRDNVNSSQNTPNAHATVNTSTNQALANHQNVDVASQVAPAPIQPSASPAQNNNNSNANSTATEPASNTNNHLASNNTTLNVPNNTNDNDSGRHLTLKEIQEDVRHSSDKPELVAIAEEASNRPKKRSRRAAPADPNATPADPAAGNGGAPVAITAPYTPTTDPNNNNIGQNAPNEVLSFDDNNIRPSTNRSVPTVTVVDNLPGFTLINGGKVGVFSHAMVRTSMFDSGDAKNYQAQGNVIALGRIRGNDTNDHGDFNGIEKTLTVNPNSELIFEFNTMTTKNYQGMTNLVIKNADNDAVLGEKVVAYGPIWRLFKVPENVSHLKIQFSPKNDAITDARGIYQLRDGYKYYDFVDSIGLHSGSHLYVERRIMEPTATNNKEFTVTTSLKNNGNFGASFNTDDFVYKVQLPEGVEYVNNSLTKDFPSNNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNGLKRRAQTILDENRNNVPLNNRVSQADIDSLTNQMQHTLIRSVDAENAVNKKVDQMEDLVNQNDELTDEEKQAAIQVIEEHKNEIIGNIGDQTTDEGVTRIKDQGIQTLSGDTATPVVKPNAKKAIRDKAAKQREIINNTPDATQDEIQDALNQLTTDETDAIDNVTNATTNDDVETAKNNGINTIGAVAPQVTHKQAARDAINQATATKRQQINSNREATQEEKNAALNELTQATNHALEQINQATTNDDVDTAKGDGLNAINPIAPVTVVKQAARDAVTHDAQQHIAEINANPDATQEERQAAIDKVNAAVTAANTNILNANTNADVEQVKTNAIQGIQAITPATKVKTDAKNAIDKSAETQHNAIFNNNDATLEEQQAAQQLLDQAVATAKQNINAADTNQEVAQAKDQGTQNIVVIQPATQVKTDARNAVNNKAREVITNINATPGATREEKQEAINRVNTLKNRALTDIGVTSTTAMVNSIRDDAVNQIGAVQPHVTKKQTATGVLTDLATAKKQEINQNTNATTEEKQVALNQVDQELATAINNINQADTNGEVDQAQQLGTKAINAIQPNIVKKPAALAQINQHYNAKLAEINATPDATDDEKNAAINILNQDRQQAIESVKQANTNAEVDQAATTAENNIDAVLVDVVKKQAARDKITAEVAKRIEAVKQTPNATDEEKQAAVNQINQLKDQAFNQINQNQTNDQVDTTTNQAINAIDNVEAEVVIKPKAIADIEKAVKEKQQQIDNSLDSTDNEKEVALQALAKEKEKALAAIDQAQTNSQVNQAATNGVSAIKIIQPETKVKPAAREKINQKANELRAQINQDKEATAEERQAALDKINDLVAKAMTNITNDRTNQQVNDSTNQVLDDIALVTPDHIVRAAARDAVKQQYEAKKQEIEQAEHATDEEKQVALNQLANNEKRALQNIDQAIANNDVKRVESNGIATLKGVEPHIVVKPEAQQPIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIDALNKIVNAIKNDIAQNKTNAEVDQTEADGNNNIKVILPKVQVKPAARQSVSAKAEAQNALIDQSDLSTEEERLAAKHLVEQALNQAIDQINHADKTVQVNQNSIDAQNIISKIKPATTVKATALQQIQNIATNKINLIKANNEATDEEQNAAIAQVEKELIKAKQQIASAVTNADVAYLLHDGKNEIREIEPVINRKASAREKLTTLVNDKKQAIEANIQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMIDEDATLNDIKQHTQFIVDEILAIKLPAEATKVSPNVGQPAPKVCTPIKKEDKQEVSKVEKELPNTGSEEMDLPLKELALITGAALLARRRSKKEKES

SEQ ID NO: 38775 - protein, 331 aa, Staphylococcus aureus; identical to SEQ ID NO: 33525
  subsp. aureus H19

SEQ ID NO: 38776 - protein, 326 aa, Staphylococcus aureus
  subsp. aureus H19
MKMKKLVKSSVATSIALIMLSNTVDAAQHITPVSEKKVDDKITLYKTTATSDNDKLNISQILTFNFIKDKSYDKDTLVLKAAGNINSGYKKPNPKDYNYSYFYWGAKYNVSVSSESNDSVNVVDYAPKNQNEEFQVQQTLGYSYGGDININGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNEAKKSKIKVTYQREMDRYTNYWNRLHWIGNNHKNQNTVTFTSTYEVDWHNHTVKLIDTNSKETNPGV

SEQ ID NO: 38777 - protein, 311 aa, Staphylococcus aureus; identical to SEQ ID NO: 38478
  subsp. aureus H19

SEQ ID NO: 38778 - protein, 258 aa, Staphylococcus aureus; identical to SEQ ID NO: 30442
  subsp. aureus H19

SEQ ID NO: 38779 - protein, 251 aa, Staphylococcus aureus; identical to SEQ ID NO: 38480
  subsp. aureus H19

SEQ ID NO: 38780 - protein, 87 aa, Staphylococcus aureus
  subsp. aureus H19
MKNITAQEIDYKVRNYLLKHKNLYEFNSSPYESGYIKFIEGNGHSFWYDMMPESGEKFYPTKYLLIYNDNKTVESKSINVEVHLTKK

SEQ ID NO: 38781 - protein, 144 aa, Staphylococcus aureus
  subsp. aureus H19
MKLFAFIFICVKSCSLLFMLNGNPRPEQLNKASEFSGLMDNMRYLYDDKHVSETNIKAQEKFLQHDLLFKINGSKIDGSKILKTEFNNKSLSDKYKNKNVDLFGTNYYNQCYFSADNMELNDGRLIEKTCMYGGVTEHDGNQIE

SEQ ID NO: 38782 - protein, 242 aa, Staphylococcus aureus
  subsp. aureus H19
MKKIKYSFILVFILFFNIKDLSYAQGDIGVGNLRNFYTKYDYIDLKGVTDKNLPIANQLEFSTGTNDLISESNNWDEISKFKGKKLDIFGIDYNGPCKSKYMYGGVTLSGQYLNSARKIPINLWVNGKHKTISTDKIATNKKLVTAQEIDVKLRRYLQEEYNIYGHNNTGKGKEYGYKSKFYSGFNKGKVLFHLNDEKSFSYDLFYTGDGLPVSFLKIYEDNKIIESEKFHLDVEISYVDSN

SEQ ID NO: 38783 - protein, 239 aa, Staphylococcus aureus; identical to SEQ ID NO: 38483
  subsp. aureus H19

SEQ ID NO: 38784 - protein, 254 aa, Staphylococcus aureus
  subsp. aureus H19
MLNVLLLIIYLIAICSVNNAYANEENPKIEDLCKKSSVDDIALHNIDKDYMTNRFIINESPVLTTEKFLDFDLLFKNFTWLDGKSAEFKDLKVEFSSSEISKEYFGKTVDIYGVYYKAHCHGEHQVKTACTYGGVTPHENNKLNEPKEIGVAVYKDNVNVNTFIVTTDKKKVTAQELDIKVRTKLNNVYKLYDRMTSDVQKGYIKFHSHSEHKESFYYDLFYIKGNLPDQYLQIYNDNKTIDSSDYHIDVYLFT

SEQ ID NO: 38785 - protein, 686 aa, Staphylococcus aureus
  subsp. aureus H19
MKFKSLITTTLALGVIASTGANFNTNEASAAAKQLDKSSSSLHHGHSKIQVPYTITVNGTSQNILSSLTFNKNQQISYKDIENKVKSVLYFNRGISDIDLRLSKQAKYTVHFKNGAKRVVDLKAGIYTADLINTSDIKAISVNVDTKKQEKDKEAKANVQVPYTITVNGTSQNILSNLTFKKNQQISYKDLENNVKSVLKSNRGITDVDLRLSKQAKYTVVFKNGTKKVIDLKAGIYTANLINSSDIKNININVDTKKQAKDKAKTSTQVPYSINLNGTSTNILSNLSFSNKPWTNYKNLTDKVKSVLKSNRGVSERDLKHAKKAYYTVYFKNGGKRVIHLNSNVYTANLVHAKDIKKIEVTVKTGSKAKAERYVPYTIAVNGTSTPNLSDLKFTGDSRVSYSDITKKVKSVLKHDRGIGERELRYAKKATYTVHFKNGTKKVINLNSKISQLNLLFVKDIKKIDIDVKTGSKAKADSYVPYTIAVNGTSTPILSKLKLSNKQLIGYQDLNEKVKSVLKHDRGINDIELKFAKQAKYTIHFKNGKTQVVDLKSDIFTRNLFSVKDIKKIDINVKQHTKANKEVKKATNNKVNFPVTINGFSNIVSNEFVFYNASKITINDLSTKLKSAMANDQGITKHDIGLAERAVYKVYFKDGTSKYVDLKTEYKDAKVFKASDVKKVDIEIKF

SEQ ID NO: 38786 - protein, 274 aa, Staphylococcus aureus; identical to SEQ ID NO: 38486
  subsp. aureus H19

SEQ ID NO: 38787 - protein, 338 aa, Staphylococcus aureus; identical to SEQ ID NO: 38487
  subsp. aureus H19

SEQ ID NO: 38788 - protein, 351 aa, Staphylococcus aureus; identical to SEQ ID NO: 38488
  subsp. aureus H19

SEQ ID NO: 38789 - protein, 45 aa, Staphylococcus aureus; identical to SEQ ID NO: 31097
  subsp. aureus H19

SEQ ID NO: 38790 - protein, 231 aa, Staphylococcus aureus; identical to SEQ ID NO: 30654
  subsp. aureus H19

SEQ ID NO: 38791 - protein, 2489 aa, Staphylococcus aureus
  subsp. aureus H19
MNLFRQQKFSIRKFNVGIFSALIATVTFISINPTTASAAEQNQPAQNQPAQPADANAQPNANAGAQANPTAQPAAPANQGQPAAQPANQGGQANPAGGAAQPAGGAAQPAAGTAQPAGQGNQADPNNAVQAQPGNQAAPANQAGQGNNQATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQAVTYGNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYKEVKQAATARKAQNATVSNTTNEEVAEADAAVDAAQTEGLHDIQVVKSQQEVADTKAKVLDKINAIQTQARVKPAADTEVENAYNTRKQEIQNSNASTTEEKEAAYTQLDDKKQEARTNIDAANSNSEVATAKDNSIAAINQVQAATTKKSDAKAEIAQKASERKTAIEAMNDSTTEEQQAAKDKVDQAVVTANADIDNAAANNDVDNAKTTNEATIAAITPDANVKPQAKQAIADKVQAQETAIDANNGATTEEKAAAKQQVQTEKTTADAAIDGAHSNAEVEAAKNAEIAKIEAIQPATTTKDDAKQAIATKANERKAAIAQTQDITVEEIEAANADVDNAVTQANSNIEAANSQNDVDQAKTTGEASIDQVTPTVNKKATARNEITTTLNNKLQAIQATPDATDEEKQAAETEANTENAKANQAITAATTNAEVDEAKTNAEAAINAVTPKVMKKQAAKDEIDQLQTAQTAVINNDQNATNEEKEAAIQQLATAVTDAKNNITAATDNNGVDTAKDAGKNSIQSTHPATAVKSNAKNEVDQAVTTQNQTIDNTTGATTEEKNAAKDLVSKAKEKAYQDILNAQTTNDVTQIKDQAVTDIQGITADTTIKDVAKGELTAKANEQKALIAQTADATTEEKEQANQQVDAQLTQGNQNIENAQSIDDVNTAKDNAIQAIDPIQASTDVKTNARAELLTEMQNKITEILNNNETTNEEKEKGIVPVRAAYVEGLENINAASTTGDVTTAKDTAVQKVQQLHANPVKKPSGKTALEQAAADKKTQIEQTPNASQQEINDAKQEVDTELNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNSDVDDALTQGKATIDAVQVDAAVKPKANQVIDAKAEETTESIDQSEQLTAEEKTEALATIKQITDQAKQGITDATKTAEVEKAKAQGLEALDNIQIDSTEKQKAIEELETALDQIEAGVNVDADATTEEKEAFTNALEDILSKATEDISDQTTNAEIATVKNNALEQLKAQRINPVVKKNALEAIREVVNKQIEIIKNADADASAKEIARTDLGRYFDRFADNLDKTQTNTEVAELQNVTIPAIEAIVPQNDPNANDTNSGSDNNDATANSNANATPENTGQPNVTESTDNANADTSSATTNNHNDAATGGTTATSTNNSSTDDANNKPTANNNSSVDASTDNSATGNGTTDKPAVESTNNGTTDKPATETDNATPAEGTTNNNSTTATNENAPTGSTATAPTTNASTGAASSADSKDNASVNDSKQNAEVNNGAESQSTNGKVAQPKSENKAKDEKDGRDSTNQSMVESTTKTLPSADITEPKVPSNTEKDKEESTTNQTDAGQLKSETNVASNEADKSEGNVDTDVSNKPSTSKPSEVKDKTTSTEDSQKADMATADTKDNQAAIGATADVNNKATQNDGANASPATVSNGSNSANQDMLKVTNTDKHKAKATSAQQGKENKAKQQAKTLPDTGMSHNDDLPYAELALGAGMAFLIRRFTKKDQQTEE

SEQ ID NO: 38792 - protein, 691 aa, Staphylococcus aureus; identical to SEQ ID NO: 35187
  subsp. aureus HO 5096 0412

SEQ ID NO: 38793 - protein, 203 aa, Staphylococcus aureus; identical to SEQ ID NO: 35186
  subsp. aureus HO 5096 0412

SEQ ID NO: 38794 - protein, 226 aa, Staphylococcus aureus; identical to SEQ ID NO: 35185
  subsp. aureus HO 5096 0412

SEQ ID NO: 38795 - protein, 233 aa, Staphylococcus aureus; identical to SEQ ID NO: 35184
  subsp. aureus HO 5096 0412

SEQ ID NO: 38796 - protein, 343 aa, Staphylococcus aureus; identical to SEQ ID NO: 35183
  subsp. aureus HO 5096 0412

SEQ ID NO: 38797 - protein, 234 aa, Staphylococcus aureus; identical to SEQ ID NO: 35182
  subsp. aureus HO 5096 0412

SEQ ID NO: 38798 - protein, 231 aa, Staphylococcus aureus; identical to SEQ ID NO: 35181
  subsp. aureus HO 5096 0412

SEQ ID NO: 38799 - protein, 232 aa, Staphylococcus aureus
  subsp. aureus HO 5096 0412
MKLTALAKATLALGILTTGVFTAESKAVHAKVELDETQRKYYIYMLKDYYSEESYEPTNISVKSEDYYGSNVLNFNHRNKNFKVFLLGDDKNKYKEKTHGLDVFAVPELIDTKGGIYSVGGITKKNVRPVFGCVSHPGLLVKKIDPKHGFSVNELFFIQKEEVSLKELDFKIRKMLVEKYRLYKGASDKGRIVINMKDEKKYVIDLSEKLSFDRMFDVMDSKQIKNIEVNLN

SEQ ID NO: 38800 - protein, 227 aa, Staphylococcus aureus; identical to SEQ ID NO: 35179
  subsp. aureus HO 5096 0412

SEQ ID NO: 38801 - protein, 228 aa, Staphylococcus aureus
  subsp. aureus HO 5096 0412
MKLKNIAKASLALGILTTGMITTTAQPVKASTLEVRSQATQDLKDYYKGQSFDLKNIGGYKEGNKVTFIYHNQQIDVTLTGNEKLEFNDDGEISNVDVFVVRENSDRSGITSSNGGITTSNKQDIIDNVKSVNMQITKKTSSNTETVTSSYYSISKENISLKELDFKLRKHLIDKNGLYKTEPKNSKIRVTMEDGGFYTFELNKKLQTNRMGDVIDGTKIKEINVELN

SEQ ID NO: 38802 - protein, 969 aa, Staphylococcus aureus
  subsp. aureus HO 5096 0412
MNNKKTATNRKGMIPNRLNKFSIRKYSVGTASILVGTTLIFGLSGHEAKAAEHTNGELNQSKNETTGTSENKTTEKVDSRQLKDNTQTATADQPKVTMSDSATVKETSSNMQSPQNATANQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPAQNQNLYNAQGNIIAKGIYDSKTNTTTYTFTNYVDQYTNVSGSFEQVSFAKRENATTDKTAYKMEVTLGNDKYSKDVIVDYGNKKGQQLISSTNYINNEDLSRNMTVYVNQPKNKYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSYSDSDSDSDSDSDSDSDSDSDSDSDSDSDSYSDSDSYSDSDSDSDSDSDSDSDSDSDSDSDSDSDSDSDSDSDSDSDSDSDSDSDSDSDSDSDSDSDSDSDSDSDRDSDSDRDSDSDSDSDSDSDSDSDSDSDSDSDSDSDSDSDSDSDSDSDSDSDSDNDSDSDAGKHTPAKPMSTVKDQHKTAKALPETGSENNNSNNGTLFGGLFAALGSLLLFGRRKKQNK

SEQ ID NO: 38803 - protein, 1375 aa, Staphylococcus aureus
  subsp. aureus HO 5096 0412
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVSRDNNSIGSAFTETVSHAGNAEDPGYYIQTVYVNPSEKTLTNAKLKVEAYHKDYPDNVGQINKNVTKIKIYQAPKDYVLNKGYDVNTNQLIDVTEQFKDKITYGTNDSVNVDFGSINNSYVVMVDTKFEFTTSESPTLVQMATLTSDGNRSVSTGNALGFTNNQSGGAGQEVYKIGNYVWEDTNKNGIQELGEVGVKGVTVVAYDNKTNKEVGRTITDEKGGYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLGNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTTTDENGKYRFDNLDSGKYKVIFEKPAGLTQTGTNTTEDDKDADGGEVDVTITDHDDFTLDNGYFEEDTSDSDSDSDSDSESDSDSDSDSDSDSDSDSGSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 38804 - protein, 1153 aa, Staphylococcus aureus
  subsp. aureus HO 5096 0412
MINRDNKKAITKKGMISNRLNKFSIRKYTVGTASILVGTTLIFGLGNQEAKAAENTSTENAKQDDATTSDNKEVVSEAENNSTTENDSTNPIKKETNTDSQPEAKEESTTSSTQQQQNNVTATTETKPQNIEKENVKPSTDKTATEDTSVILEEKKAPNNTNNDVTTKPSTSEIQKKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 38805 - protein, 434 aa, Staphylococcus aureus [sequence omitted]

SEQ ID NO: 38806 - protein, 937 aa, Staphylococcus aureus
  subsp. aureus HO 5096 0412
MNMKKKEKHAIRKKSIGVASVLVGTLIGFGLLSSKEADASENSVTQSDSASNESKSNDSSSVSAAPKTVDTNVSDTKTTSNTNSGETSVAQNPAQQETTQSASTNATTEETPATGEATTTATNQANTPATTQSSNTNAEELVNQTNNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSESDSDSDSDSDSDSDSDSESDSDSDSGSNNNVVPPNSPKNGTNASNKNEAKDSKEPLPDTGSEDEANTSLIWGLLASLGSLLLFRRKKENKDKK

SEQ ID NO: 38807 - protein, 350 aa, Staphylococcus aureus; identical to SEQ ID NO: 35167
  subsp. aureus HO 5096 0412

SEQ ID NO: 38808 - protein, 109 aa, Staphylococcus aureus; identical to SEQ ID NO: 33345
  subsp. aureus HO 5096 0412

SEQ ID NO: 38809 - protein, 319 aa, Staphylococcus aureus; identical to SEQ ID NO: 35151
  subsp. aureus HO 5096 0412

SEQ ID NO: 38810 - protein, 253 aa, Staphylococcus aureus
  subsp. aureus HO 5096 0412
MIFLAMINPQKGDVQMKKNITNKIILTATLLILGTSSAQLPNTPIGFSSEAKAYHIGQDETNINELIKYYTQKPLTFSNRWLYQYDDGNIYVEFKRYSWSAHIRLWGAESWGNINQLRDRYVDVFGLKDKDTRRLWWVYTDTFTGGVTPAASSSDKPYNIYVQYKDKLQTFIGAHKIYQGNKPVLTLKEIDFRVRESLIKNKILYNENRNKGNIHITGGGNNFTIDLSKRLHSDLANVYVKNPQKITVEVLID

SEQ ID NO: 38811 - protein, 241 aa, Staphylococcus aureus; identical to SEQ ID NO: 35149
  subsp. aureus HO 5096 0412

SEQ ID NO: 38812 - protein, 251 aa, Staphylococcus aureus
  subsp. aureus HO 5096 0412
MGNSRKGDFHMKKNIMNKLVLSTALLLLGTTSTQLPKTPISFSSEAKAYNISENETNINELIKYYTQPHFSLSGKWLWQKPNGSIHATLQTWVWYSHIQVFGAESWGNINQLRDKYVDIFGTKDEDTVEGYWTYDETFTGGVTPAATSSDKSYKLFLKYSDKQQTIIGGLEFYKGNKPVLTLKELDFRIRQTLINNKKLYNGEFNKGQIKITGGGNNYTIDLSKKLKLTDTNRYVKNPRHAEIEVILEKSN

SEQ ID NO: 38813 - protein, 372 aa, Staphylococcus aureus; identical to SEQ ID NO: 35147
  subsp. aureus HO 5096 0412

SEQ ID NO: 38814 - protein, 250 aa, Staphylococcus aureus; identical to SEQ ID NO: 35190
  subsp. aureus HO 5096 0412

SEQ ID NO: 38815 - protein, 270 aa, Staphylococcus aureus; identical to SEQ ID NO: 35140
  subsp. aureus HO 5096 0412

SEQ ID NO: 38816 - protein, 895 aa, Staphylococcus aureus
  subsp. aureus HO 5096 0412
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDKNDAVVTNDQSSSDASNQTNTNTSNQNTSTTNNTSDQPYATTNMSQPAQPVSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLLEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDIKTKDDATSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPNDIHKTVDKTVKTKEKAGTPSKENKLSQSKMLPKTGETTSSQSWWGLYALLGMLALFIPKFRKESK

SEQ ID NO: 38817 - protein, 2189 aa, Staphylococcus aureus
  subsp. aureus HO 5096 0412
MNLLKKNKYSIRKYKVGIFSTLIGTVLLLSNPNGAQALTTDQNVQGESNQALPGNSHNTNVDTSRDITNSSQNTPNQHTTANASTNQALANHHNVGESNQVVPMPVQPSTSSASNNNHSDAKSTATESAANTNNNLSSNNNTLNVPNNTDNNDSARHLTLKEIQEDVRHSSDKPELVAIAEEASNRPKKRSRRAAPADPNATPADPTATPADPAAGNGSAPVAITAPYTPTTDPNANNIGQNAPNEVLSFDDNGIRPSTNRSVPTVTVVDNLPGFTLINGGKVGVFSHAMVRTSMFDSGDAKNYQAQGNVIALGRIRGNDVNDHGDFNGIEKTLTVNPNSELIFEFNTMTTKNYQGMTNLVIKNADNDAVIGEKVVAYGPIWRLFKVPENVSHLKIQFVPKNDAITDPRGIYQLRDGYKYYDFVDSIGLHSGSHVYVERRTMEPTATNNKEFSVTTSLKNNGNFGASFNTDDFVYKIQLPEGVEYVNNSLTKDFQSGNSGVDINDFNVTYDAANRIITIKSTGGGSGNSPARLMPDKILDLKYKLRVNNVPTPRTVTFNDTLTYKTFSQDFINSPAESHTVSTEPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSRDTATPVVKPNAKQAIRDKAAKQREIINNTPDATQDEIQDALNQLTTDETDAIDNVTNATTNADVETAKNNGINTIGAVVPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIDKVNAAVAAANANILNANTNADVEQVKTNAIQGIQAIEPATKVKTDAKNAIDQSAETQHNAIFNNNDATLEEQQAAQQLLDQAVATAKQNINAADTNQEVAQAKDQGMQNIVVIQPATQVKTDARNTVNEKAREVITNINATPGATREEKQEAIDRVNALKNRALTDIGVTSTTAMVNSIRDDAVNQIGAVQPHVTKKQTATGVLNDLATAKKQEINQNTNATTEEKQIALNQVDQELAAALNNINQADTNAEVDQAQQLGAQAINAIQPNIVKKPAALAQINQHYNAKLAEINATPDATDDEKNAAINTLNQDRQQAIESLNQANTNNEVDQAAITAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSIDSTDNEKEVATQALAREKEKALVAIEQAQTNEQVNQAATDGITAIKIIQPETRVKPAAREKINQKANELRAQINQDKEATAEERQAALDKINDLVTQAMTNITNDRTDQQVNDSTNQALGDIALVTPDHIIRAAARDAVKQQYEAKKQEIEQAEHATDEEKQVALNQLANNEKRALQNIDQAIANNDVKRVESNGIATLKGVEPHIVVKPEAQQAIKASADNQVESIKDTPHATTDELDEANQQINDTLKQGQQDIDNTTQDVAVNDVRNQTIKAIEQIKPKVRRKRAALDNIDESNNNQLDAIRNTLDTTQDERNIAIAELNKIVNTIKNDIAQNKTNAEVDQTEADGNNNIKVILPKVQVKPAARHSVSAKAEAQNALIDQSDLSTEEERLAAKHLVDQALNQAIDQINHADKTAQVNQNSIDAQKIISQIKPATTVKTTALQQIQNIATNKINLIKANNEATDEEQNAAIAQVEQALIKAKQQIASAVTNADVAYLLHDGKNEIREIEPVINRKSTAREQLTTLLNDKKQAIEANVQATVEERNSILAQLQNIYDTAIGQIDQDRSNAQVDKTASLNLQTIHDLDVHPIKKPDAEKTINDDLARVTHLVQNYRKVSDRNKADALKAITALKLQMDEELKIARTNADVDAVLKRFKVALGDIEAVITEKENSLLRIDNIAQQTYAKFKSIATPEQLAKVKALIDQYVADGNRMIDEDATLNDIKQHTQFIVDEILAIKLPAEVTNVSPKVGQPAPKVCTPIKKEDKQEVHKVEKELPNTGSEEMDLPLKELALITGAALLARRRTKNEKES

SEQ ID NO: 38818 - protein, 331 aa, Staphylococcus aureus; identical to SEQ ID NO: 35176
  subsp. aureus HO 5096 0412

SEQ ID NO: 38819 - protein, 258 aa, Staphylococcus aureus; identical to SEQ ID NO: 30410
  subsp. aureus HO 5096 0412

SEQ ID NO: 38820 - protein, 251 aa, Staphylococcus aureus; identical to SEQ ID NO: 30946
  subsp. aureus HO 5096 0412

SEQ ID NO: 38821 - protein, 256 aa, Staphylococcus aureus; identical to SEQ ID NO: 35196
  subsp. aureus HO 5096 0412

SEQ ID NO: 38822 - protein, 242 aa, Staphylococcus aureus; identical to SEQ ID NO: 35197
  subsp. aureus HO 5096 0412

SEQ ID NO: 38823 - protein, 239 aa, Staphylococcus aureus; identical to SEQ ID NO: 35198
  subsp. aureus HO 5096 0412

SEQ ID NO: 38824 - protein, 254 aa, Staphylococcus aureus; identical to SEQ ID NO: 30809
  subsp. aureus HO 5096 0412

SEQ ID NO: 38825 - protein, 682 aa, Staphylococcus aureus; identical to SEQ ID NO: 35172
  subsp. aureus HO 5096 0412

SEQ ID NO: 38826 - protein, 338 aa, Staphylococcus aureus; identical to SEQ ID NO: 35158
  subsp. aureus HO 5096 0412

SEQ ID NO: 38827 - protein, 350 aa, Staphylococcus aureus; identical to SEQ ID NO: 35159
  subsp. aureus HO 5096 0412

SEQ ID NO: 38828 - protein, 45 aa, Staphylococcus aureus; identical to SEQ ID NO: 31097
  subsp. aureus HO 5096 0412

SEQ ID NO: 38829 - protein, 231 aa, Staphylococcus aureus; identical to SEQ ID NO: 33433
  subsp. aureus HO 5096 0412

SEQ ID NO: 38830 - protein, 2438 aa, Staphylococcus aureus
  subsp. aureus HO 5096 0412
MNLFRQQKFSIRKFNVGIFSALIATVTFISINPTTASAAEQNQPAQNQPAQPADPNAQPNANAGAQANPTAQPAAPANQGGQADPAANQGGQANPAGGAVQPAAGTTQPAGQGNQADPNNAAQAQPGNQAAPANQAGQGNNQATPNNNATPANQTQPANAPAGAQPAAAVAANGQTQDPNASNTGEGSINTTLTFDDPAISTDENRQDPTVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNIANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKITAAQQSKKVTQDEVAALVTKINNDKNNAIAEINKQTTAQGVTTEKDNGIAVLEQDVITPTVKPQAKQDIIQAVTTRKQQIKKSTASLQDEKDVANDKIGKIETKAIKDIDAATTNAQVEAIKTKAINDINQTAPATTAKAEALEEFDEVVQAQIDQAPLNPDTTNEEVAEAIERINAAKVSGVKAIEATTTAQDLERVKNEEIFKIENITDSTQTKMDAYKEVKQAATARKAQNATVSNATDEEVAEANAAVDAAQTEGLHDIQVVKSQQEVADTKAKVLDKINAIQTQSRVKPAADTEVDNAYNTRKQEIQNSNASTTEEKEAAYTELDAKKQEARTNLDAANTNSAVTTAKDNGIAAINQVQAATTKKSDAKAEIAQKASERKTAIEAMNDSTSEEQQAAKDKVDQAVVTANADIDNAAANSDVDNAKTTNEATIAAITPDANVKPQAKQAIADKVQAQETAIDANNGAITEEKAAAKQQVQTEKTTADTAIDGAHSNAEVEAAKNAEIAKIEAIQPATTTKDNAKQAIATKANERKTAIAQTQDITAEEIAAANADVDNAVIQANSNIEAANSQNDVDQAKTTGETSIDQVTPTVNKKATARNEITTTLNNKLQEIQATPDATDEEKQDAETEANTENAKANQAITAATTNAEVDEAKTNAEAAINAVTPKVMKKQAAKDEIDQLQAAQTAVINNDQNATNEEKEAAIQQLATAVTDAKNNITAATDNNGVDTAKDAGKNSIQSTQPATAVKSNAKNDVDQAVTTQNQAIDNTTGATTEEKNAAKDLVSKAKEKAYQDILNAQTTNDVTQLKDQAVADIQGITADTTIKDVAKGELTAKANEQKALIAQTADATTEEKEQANQQVDAQLTQGNQNIENAQSIDDVNTAKDNAVQAIDPIQASTDVKTNARAELLNEMQNKITEILNDNTTTNEEKGKDIGPVRAAYEEGLNNINVANSTGDVTTAKDAAVQKVQQLHANPVKKPAGKTELDQAAADKKTQIEQTPNASQQEINDAKQEVDTELNQAKTNIDQSSTDDYVDAAVRDGKAKINAVKTFSEYKKDALAKIADAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNSDVDDALTQGKATIDAVQVDATVKAKANQAIDAKAQETKESIDQSDQLTAEEKTEALATIKQITDQAKQGITDATTTAEVEKAKAQGLEAFDNIQIDSTEKQKAIEELETALDQIEAGVNVDSDATTEEKEVFTNALEEILSKATEDISDQTTNAEIATVKNSALEQLKAQRINPEVKKNALEAIREVVNKQIEIIKNADADASAKEIARTDLGRYFDRFADDLDKTQTNAEVAELQNVTIPAIEAIVPQNDPDANHSSSDNNDATANTNVNAEPDNAGQPNVTESTDNANADTSSTTTNNHNDAATGETTATSTNNSSTDDANDKPTANNNSSVDASIDNSATGNGTTDKPATTESTEKTSSADSKDNASVNDSNQNAEVNNSAESQPTNGKVAQPKSENKAKVEKDGRDSTNQSMVESTTETLPSADITEPNVPSNTSKDKEESTSNQTDAGQLKSETNVASNEADKSPSKADTEVSNKPSTSASSEAKDKMTSTEDSQKADMATADTKDNQASIGSSADANNKATQNDGANASPATVSNGSNSANQDMLNVTKPEENKANAKSDQQGKVNKPKQQAKTLPDTGMSHNDDLPYAELALGAGMAFLIRRFTKKDQQTEE

SEQ ID NO: 38831 - protein, 808 aa, Staphylococcus aureus; identical to SEQ ID NO: 35205
  subsp. aureus HO 5096 0412

SEQ ID NO: 38832 - protein, 141 aa, Staphylococcus aureus; identical to SEQ ID NO: 31189
  subsp. aureus HO 5096 0412

SEQ ID NO: 38833 - protein, 309 aa, Staphylococcus aureus; identical to SEQ ID NO: 33946
  subsp. aureus HO 5096 0412

SEQ ID NO: 38834 - protein, 315 aa, Staphylococcus aureus; identical to SEQ ID NO: 35201
  subsp. aureus HO 5096 0412

SEQ ID NO: 38835 - protein, 325 aa, Staphylococcus aureus; identical to SEQ ID NO: 35200
  subsp. aureus HO 5096 0412

SEQ ID NO: 38836 - protein, 1015 aa, Staphylococcus aureus
  subsp. aureus HO 5096 0412
MKNNLRYGIRKHKLGAASVFLGTMIVVGMGQDKEAAASEQKTTTVEENGNSATENKVNETQTTTTNVNTIDETQSYSATATEQPSNATQVTTEEAPKAVQAPQTAQPANLETVKEEVVKEEAKPQVKETTQSQDNSGDQRQVDLTPKKATQNQVAETQVEVAQPRTASESKPRVTRSADVVEAKEASDEKVETGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQNNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVITESNLVEFDEESTKGILTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNSVEYEEDTLPQVSGHNEGQQTIEEDTTPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGILFGGLFSILGFALLRRNKKNHKA

SEQ ID NO: 38837 - protein, 233 aa, Staphylococcus aureus; identical to SEQ ID NO: 33414
  subsp. aureus HO 5096 0412

SEQ ID NO: 38838 - protein, 897 aa, Staphylococcus aureus
  subsp. aureus HO 5096 0412
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTTFDPNQSGNTFMAANFTVTDKVKSGDYFTAKLPDSLTGNGDVDYSNSNNTMPIADIKSTNGDVVATATYNILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPVDPTPGPPVDPEPSPEPEPEPTPDPEPSPDPEPEPTPDPEPSPDPEPEPTPDPEPSPDPDSDSDSDSDSDSNSDLDSDSGSDSDSDSDSDSDSDSDSDLDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKASKQHKTDDLPETGDKSENTNATLFGAMMALLGSLLLFRKRKQDHKEKA

SEQ ID NO: 38839 - protein, 681 aa, Staphylococcus aureus; identical to SEQ ID NO: 35164
  subsp. aureus HO 5096 0412

SEQ ID NO: 38840 - protein, 996 aa, Staphylococcus aureus
  subsp. aureus HO 5096 0412
MNKNVLKFMVFIMLLNIITPLFNKNDAFAARDISSTNVTDLTVSPSKIEDGGKTTVKMTFDDKNGKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKAIEKTKDVSAQKVWEGSQKVKPTIYFKLYKQDDNQNTTPVDKAEIKKLEDGTTKVTWSNLPENDKNGKAIKYLVKEVNAQGEDTTPEGYTKKENGLVVTNTEKPIETTSISGEKVWDDKDNQDGKRPEKVSVNLLANGEKVKTVDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPETTSISGEKVWDDKDNQDGKRPEKVSVNLLANGEKVETVDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDIGNLIVTNKYTPEKPNKPIYPEKPKDKTPPTKPDHSNKVKPTPPDKPSKVDKADQSKDNKTKPENPLKELPKTGMKIITSWITWVFIGILGLYLILRKRFNS

SEQ ID NO: 38841 - protein, 291 aa, Staphylococcus aureus; identical to SEQ ID NO: 30390
  subsp. aureus IS-105

SEQ ID NO: 38842 - protein, 220 aa, Staphylococcus aureus
  subsp. aureus IS-105
MGEFEVKYLTGFILILLLEGIFTNSASAIEYSDLHHKSELDSKRLYNAKVSFANPTQLENKKTNDRLLKHDLLFHDMFVNDAWKKDFKVEFENEALSKKFVNKDIDIFAGNYGYGCHGGETNKTLCSYGGVTLSDNNKYDDYKNIPCNLWIDGHQTGIELTAVKTKKKIVTIQELDVQLRNYLNEKYKLYELGGDIVKGYVKYHNDDEKNVEYDFYRVCV

SEQ ID NO: 38843 - protein, 233 aa, Staphylococcus aureus; identical to SEQ ID NO: 33414
  subsp. aureus IS-105

SEQ ID NO: 38844 - protein, 733 aa, Staphylococcus aureus
  subsp. aureus IS-105
MNNKKTATNRKGMIPNRLNKFSIRKYSVGTASILVGTTLIFGLSGHEAKAAEHTNGELNQSKNETTGTSENKTTEKVDSRQLKDNTQTATADQPKVTMSDSATVKETSSNMQSPQNATANQSTTQTSNVTTNDKSSTTYSNETDKSNLTQAKDVSATPKTTTIKPRTLNRMAVNTVAAPQQGTNVNDKVHFSNIDIAIDKGHLNKDTGKTEFWATSSDVLKLKANYTIDDSVKEGDTFTFKYGQYFRPGSVRLPAQNQNLYNAQGNIIAKGIYDSKTNTTTYTFTNYVDQYTNVSGSFEQVSFAKRENATTDKTAYKMEVTLGNDKYSKDVIVDYGNKKGQQLISSTNYINNEDLSRNMTVYVNQPKNKYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSD

SEQ ID NO: 38845 - protein, 134 aa, Staphylococcus aureus
  subsp. aureus IS-105
SDSDSDSDSDSDSDRDSDSDRDSDSDSDSDSDSDSDSDSDSDSDSDSDSDSDSDSDSDSDSDSDSDSDNDSDSDAGKHTPAKPMSTVKDQHKTAKALPETGSENNNSNNGTLFGGLFAALGSLLLFGRRKKQNK

SEQ ID NO: 38846 - protein, 1197 aa, Staphylococcus aureus
  subsp. aureus IS-105
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVSRDNNSIGSAFTETVSHAGNAEDPGYYIQTVYVNPSEKTLTNAKLKVEAYHKDYPDNVGQINKNVTKIKIYQAPKDYVLNKGYDVNTNQLIDVTEQFKDKITYGTNDSVNVDFGSINNSYVVMVDTKFEFTTSESPTLVQMATLTSDGNRSVSTGNALGFTNNQSGGAGQEVYKIGNYVWEDTNKNGIQELGEVGVKGVTVVAYDNKTNKEVGRTITDEKGGYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLGNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTTTDENGKYRFDNLDSGKYKVIFEKPAGLTQTGTNTTEDDKDADGGEVDVTITDHDDFTLDNGYFEEDTSDSDSDSDSDSESDSDSDSDSDSDSDSDSDSDSDSDSDSDSDSDSDSDSDSDSDSDSDSDSDSDSDSDSDSDSD

SEQ ID NO: 38847 - protein, 147 aa, Staphylococcus aureus
  subsp. aureus IS-105
MFEKQYIYGGVTLAGDYLEKSRRIPINLWVNGEHQTISTDKVSTNKKLVTAQEIDTKLRRYLQEEYNIYGFNDTNKGRKYGNKSKFSSGFNAGKILFHLNDGSSFSYDLFDTGTGQAESFLKIYNDNKTVETEKFHLDVEISYKDES

SEQ ID NO: 38848 - protein, 242 aa, Staphylococcus aureus; identical to SEQ ID NO: 35197
  subsp. aureus IS-105

SEQ ID NO: 38849 - protein, 256 aa, Staphylococcus aureus; identical to SEQ ID NO: 35196
  subsp. aureus IS-105

SEQ ID NO: 38850 - protein, 165 aa, Staphylococcus aureus; identical to SEQ ID NO: 30805
  subsp. aureus IS-105

SEQ ID NO: 38851 - protein, 258 aa, Staphylococcus aureus; identical to SEQ ID NO: 30410
  subsp. aureus IS-105

SEQ ID NO: 38852 - protein, 895 aa, Staphylococcus aureus; identical to SEQ ID NO: 35192
  subsp. aureus IS-105

SEQ ID NO: 38853 - protein, 254 aa, Staphylococcus aureus; identical to SEQ ID NO: 30809
  subsp. aureus IS-105

SEQ ID NO: 38854 - protein, 146 aa, Staphylococcus aureus
  subsp. aureus IS-105
MKRILIIVVLLFCYSQNHIATADVGVLNLRNYYGSYPIEDHQSINPENNHLSHQLVFSMDNSTVTAEFKNVDDVKKFKNHAVDVYGLSYSGYCLKNKYIYGGVTLAGDYLEKSRRIPINLWVNGEHQTISTDKVSTNKKLVTAESV

SEQ ID NO: 38855 - protein, 109 aa, Staphylococcus aureus; identical to SEQ ID NO: 33345
  subsp. aureus IS-105

SEQ ID NO: 38856 - protein, 350 aa, Staphylococcus aureus; identical to SEQ ID NO: 35167
  subsp. aureus IS-105

SEQ ID NO: 38857 - protein, 644 aa, Staphylococcus aureus; identical to SEQ ID NO: 35166
  subsp. aureus IS-105

SEQ ID NO: 38858 - protein, 90 aa, Staphylococcus aureus
  subsp. aureus IS-105
TAVKTKKKIVTIQELDVQLRNYLNEKYKLYELGGDIVKGYVKYHNDDEKNVEYDFYNLNGEYGHEVLKMYADNKTINSDKLHLDIYLFKS

SEQ ID NO: 38859 - protein, 372 aa, Staphylococcus aureus; identical to SEQ ID NO: 35147
  subsp. aureus IS-105

SEQ ID NO: 38860 - protein, 682 aa, Staphylococcus aureus; identical to SEQ ID NO: 35172
  subsp. aureus IS-105

SEQ ID NO: 38861 - protein, 107 aa, Staphylococcus aureus; identical to SEQ ID NO: 35348
  subsp. aureus IS-105

SEQ ID NO: 38862 - protein, 231 aa, Staphylococcus aureus; identical to SEQ ID NO: 33433
  subsp. aureus IS-105

SEQ ID NO: 38863 - protein, 331 aa, Staphylococcus aureus; identical to SEQ ID NO: 35176
  subsp. aureus IS-105

SEQ ID NO: 38864 - protein, 171 aa, Staphylococcus aureus
  subsp. aureus IS-105
MATNLAKKTTKKPGKEDGNKPGKEDGNKPGKEDGNKPGKEDGNKPGKEDGNKPGKEDGNKPGKEDGNKPGKEDGNGVHVVKPGDTVNDIAKANGTTADKIAADNKLADKNIIKPGQELVVDKKQPANHADANKAQALPETGEENPFIGTTVFGGLSLALGAALLAGRRREL

SEQ ID NO: 38865 - protein, 643 aa, Staphylococcus aureus
  subsp. aureus IS-105
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTTFDPNQSGNTFMAANFTVTDKVKSGDYFTAKLPDSLTGNGDVDYSNSNNTMPIADIKSTNGDVVATATYNILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPVDPTPGPPVDPEPSPEPEPEPTPDPEPSPDPEPEPTPDPEPSPDPEPEPTPDPEPSPDPDSDSDSDSDSDSNSDLDSDSGSDSDSDSDSDSDSDSDSDLD

SEQ ID NO: 38866 - protein, 434 aa, Staphylococcus aureus [sequence omitted]

SEQ ID NO: 38867 - protein, 754 aa, Staphylococcus aureus
  subsp. aureus IS-105
MNMKKKEKHAIRKKSIGVASVLVGTLIGFGLLSSKEADASENSVTQSDSASNESKSNDSSSVSAAPKTVDTNVSDTKTTSNTNSGETSVAQNPAQQETTQSASTNATTEETPATGEATTTATNQANTPATTQSSNTNAEELVNQTNNETTSNDTNTVSSVNSPQNSTNAENVSTTQDTSTEATPSNNESAPQSTDASNKDVVNQAVNTSAPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSD

SEQ ID NO: 38868 - protein, 2438 aa, Staphylococcus aureus; identical to SEQ ID NO: 35156
  subsp. aureus IS-105

SEQ ID NO: 38869 - protein, 2189 aa, Staphylococcus aureus; identical to SEQ ID NO: 35193
  subsp. aureus IS-105

SEQ ID NO: 38870 - protein, 502 aa, Staphylococcus aureus
  subsp. aureus IS-105
MRDKKGPVNKRVDFLSNKLNKYSIRKFTVGTASILIGSLMYLGTQQEAEAAENNIENPTTLKDNVQSKEVKIEEVTNKDTAPQGVEAKSEVISNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEFGGEKI

SEQ ID NO: 38871 - protein, 934 aa, Staphylococcus aureus; identical to SEQ ID NO: 35170
  subsp. aureus IS-105

SEQ ID NO: 38872 - protein, 992 aa, Staphylococcus aureus; identical to SEQ ID NO: 35171
  subsp. aureus IS-105

SEQ ID NO: 38873 - protein, 142 aa, Staphylococcus aureus
  subsp. aureus IS-105
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVESV

SEQ ID NO: 38874 - protein, 125 aa, Staphylococcus aureus; identical to SEQ ID NO: 35152
  subsp. aureus IS-105

SEQ ID NO: 38875 - protein, 319 aa, Staphylococcus aureus; identical to SEQ ID NO: 35151
  subsp. aureus IS-105

SEQ ID NO: 38876 - protein, 238 aa, Staphylococcus aureus; identical to SEQ ID NO: 35150
  subsp. aureus IS-105

SEQ ID NO: 38877 - protein, 241 aa, Staphylococcus aureus; identical to SEQ ID NO: 35149
  subsp. aureus IS-105

SEQ ID NO: 38878 - protein, 241 aa, Staphylococcus aureus; identical to SEQ ID NO: 35148
  subsp. aureus IS-105

SEQ ID NO: 38879 - protein, 110 aa, Staphylococcus aureus; identical to SEQ ID NO: 36486
  subsp. aureus IS-105

SEQ ID NO: 38880 - protein, 691 aa, Staphylococcus aureus; identical to SEQ ID NO: 35187
  subsp. aureus IS-105

SEQ ID NO: 38881 - protein, 124 aa, Staphylococcus aureus
  subsp. aureus IS-105
SDSDSDSDSDSDSDSDSDSDSDSDSDSDSDSDSDSDSDSDSDSDSDSDSDSRVTPPNNEQKAPSNPKGEVNHSNKASKQHKTDDLPETGDKSENTNATLFGAMMALLGSLLLFRKRKQDHKEKA

SEQ ID NO: 38882 - protein, 114 aa, Staphylococcus aureus
  subsp. aureus IS-105
SDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 38883 - protein, 991 aa, Staphylococcus aureus
  subsp. aureus IS-105
MINRDNKKAITKKGMISNRLNKFSIRKYTVGTASILVGTTLIFGLGNQEAKAAENTSTENAKQDDATTSDNKEVVSEAENNSTTENDSTNPIKKETNTDSQPEAKEESTTSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQADDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSD

SEQ ID NO: 38884 - protein, 203 aa, Staphylococcus aureus; identical to SEQ ID NO: 35186
  subsp. aureus IS-105

SEQ ID NO: 38885 - protein, 226 aa, Staphylococcus aureus; identical to SEQ ID NO: 35185
  subsp. aureus IS-105

SEQ ID NO: 38886 - protein, 233 aa, Staphylococcus aureus; identical to SEQ ID NO: 35184
  subsp. aureus IS-105

SEQ ID NO: 38887 - protein, 343 aa, Staphylococcus aureus; identical to SEQ ID NO: 35183
  subsp. aureus IS-105

SEQ ID NO: 38888 - protein, 234 aa, Staphylococcus aureus; identical to SEQ ID NO: 35182
  subsp. aureus IS-105

SEQ ID NO: 38889 - protein, 231 aa, Staphylococcus aureus; identical to SEQ ID NO: 35181
  subsp. aureus IS-105

SEQ ID NO: 38890 - protein, 232 aa, Staphylococcus aureus; identical to SEQ ID NO: 35180
  subsp. aureus IS-105

SEQ ID NO: 38891 - protein, 227 aa, Staphylococcus aureus; identical to SEQ ID NO: 35179
  subsp. aureus IS-105

SEQ ID NO: 38892 - protein, 228 aa, Staphylococcus aureus; identical to SEQ ID NO: 35178
  subsp. aureus IS-105

SEQ ID NO: 38893 - protein, 1261 aa, Staphylococcus aureus
  subsp. aureus IS-105
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTSSKNTTSSSDTKSVASTSSTEQQTNISTNQSTASNTTSQSTAPASTHLKQTSTTSTSTAPVKLRTFSRLAMSTFASAATTTALTANTITVNKDNLKQYMTTSGNATYDQSTGVVTLTQDAYSQKGAITLGTRIDSNKSFHFSGKVNLGNKYEGNGNGGDGIGFAFSPGVLGETGLNGAAVGIGGLSNAFGFKLDTYHNTSKPNSAAKANADPSSVAGGGAFGAFVTTDSTGVATTYTSSSTADNAAKLKVQPTNNTFQNFDITYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDKSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLFKSQSLSTSTSDSASTSQSVSDSTSNSISTSESLSESVSTSESLSDSISTSDSDSKSLSLSTSQSGSTSTSTSTSASVRMSESQSMSGSMSASQSDSTSISTSFSDSTSDSKSASTASSESVSQSVSTSTSGSVSTSTSLSTSSSERTSTSLSASTSLSTSESGSTSDSTSTSDSISEAISGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 38894 - protein, 681 aa, Staphylococcus aureus; identical to SEQ ID NO: 35164
  subsp. aureus IS-105

SEQ ID NO: 38895 - protein, 1183 aa, Staphylococcus aureus; identical to SEQ ID NO: 35165
  subsp. aureus IS-105

SEQ ID NO: 38896 - protein, 112 aa, Staphylococcus aureus
  subsp. aureus IS-105
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKNIHILKE

SEQ ID NO: 38897 - protein, 209 aa, Staphylococcus aureus; identical to SEQ ID NO: 37300
  subsp. aureus IS-105

SEQ ID NO: 38898 - protein, 315 aa, Staphylococcus aureus; identical to SEQ ID NO: 35201
  subsp. aureus IS-105

SEQ ID NO: 38899 - protein, 325 aa, Staphylococcus aureus; identical to SEQ ID NO: 35200
  subsp. aureus IS-105

SEQ ID NO: 38900 - protein, 274 aa, Staphylococcus aureus; identical to SEQ ID NO: 30872
  subsp. aureus IS-105

SEQ ID NO: 38901 - protein, 338 aa, Staphylococcus aureus; identical to SEQ ID NO: 35158
  subsp. aureus IS-105

SEQ ID NO: 38902 - protein, 350 aa, Staphylococcus aureus; identical to SEQ ID NO: 35159
  subsp. aureus IS-105

SEQ ID NO: 38903 - protein, 211 aa, Staphylococcus aureus; identical to SEQ ID NO: 34056
  subsp. aureus IS-105

SEQ ID NO: 38904 - protein, 808 aa, Staphylococcus aureus; identical to SEQ ID NO: 35205
  subsp. aureus IS-105

SEQ ID NO: 38905 - protein, 141 aa, Staphylococcus aureus; identical to SEQ ID NO: 31189
  subsp. aureus IS-105

SEQ ID NO: 38906 - protein, 193 aa, Staphylococcus aureus
  subsp. aureus IS-105
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSESDSDSDSGSNNNVVPPNSPKNGTNASNKNEAKDSKEPLPDTGSEDEANTSLIWGLLASLGSLLLFRRKKENKDKK

SEQ ID NO: 38907 - protein, 312 aa, Staphylococcus aureus; identical to SEQ ID NO: 30391
  subsp. aureus IS-105

SEQ ID NO: 38908 - protein, 325 aa, Staphylococcus aureus; identical to SEQ ID NO: 30484
  subsp. aureus IS-105

SEQ ID NO: 38909 - protein, 1226 aa, Staphylococcus aureus
  subsp. aureus IS-111
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDS

SEQ ID NO: 38910 - protein, 947 aa, Staphylococcus aureus; identical to SEQ ID NO: 31975
  subsp. aureus IS-111

SEQ ID NO: 38911 - protein, 319 aa, Staphylococcus aureus; identical to SEQ ID NO: 30741
  subsp. aureus IS-111

SEQ ID NO: 38912 - protein, 165 aa, Staphylococcus aureus; identical to SEQ ID NO: 30742
  subsp. aureus IS-111

SEQ ID NO: 38913 - protein, 109 aa, Staphylococcus aureus; identical to SEQ ID NO: 30744
  subsp. aureus IS-111

SEQ ID NO: 38914 - protein, 350 aa, Staphylococcus aureus; identical to SEQ ID NO: 30602
  subsp. aureus IS-111

SEQ ID NO: 38915 - protein, 645 aa, Staphylococcus aureus; identical to SEQ ID NO: 30747
  subsp. aureus IS-111

SEQ ID NO: 38916 - protein, 163 aa, Staphylococcus aureus
  subsp. aureus IS-111
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 38917 - protein, 681 aa, Staphylococcus aureus; identical to SEQ ID NO: 32025
  subsp. aureus IS-111

SEQ ID NO: 38918 - protein, 434 aa, Staphylococcus aureus [sequence omitted]

SEQ ID NO: 38919 - protein, 351 aa, Staphylococcus aureus; identical to SEQ ID NO: 30720
  subsp. aureus IS-111

SEQ ID NO: 38920 - protein, 338 aa, Staphylococcus aureus; identical to SEQ ID NO: 30699
  subsp. aureus IS-111

SEQ ID NO: 38921 - protein, 274 aa, Staphylococcus aureus; identical to SEQ ID NO: 30872
  subsp. aureus IS-111

SEQ ID NO: 38922 - protein, 698 aa, Staphylococcus aureus
  subsp. aureus IS-111
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDQTATQ

SEQ ID NO: 38923 - protein, 372 aa, Staphylococcus aureus
  subsp. aureus IS-111
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNELTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRLFKKA

SEQ ID NO: 38924 - protein, 1102 aa, Staphylococcus aureus; identical to SEQ ID NO: 32042
  subsp. aureus IS-111

SEQ ID NO: 38925 - protein, 807 aa, Staphylococcus aureus; identical to SEQ ID NO: 30716
  subsp. aureus IS-111

SEQ ID NO: 38926 - protein, 141 aa, Staphylococcus aureus; identical to SEQ ID NO: 30715
  subsp. aureus IS-111

SEQ ID NO: 38927 - protein, 327 aa, Staphylococcus aureus; identical to SEQ ID NO: 30538
  subsp. aureus IS-111

SEQ ID NO: 38928 - protein, 311 aa, Staphylococcus aureus; identical to SEQ ID NO: 30617
  subsp. aureus IS-111

SEQ ID NO: 38929 - protein, 61 aa, Staphylococcus aureus; identical to SEQ ID NO: 33840
  subsp. aureus IS-111

SEQ ID NO: 38930 - protein, 157 aa, Staphylococcus aureus
  subsp. aureus IS-111
MKFTALAKATLALGILTTGTLTTEVHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNISKEKGEDAFVKGYPYYIKKEK

SEQ ID NO: 38931 - protein, 232 aa, Staphylococcus aureus; identical to SEQ ID NO: 30765
  subsp. aureus IS-111

SEQ ID NO: 38932 - protein, 232 aa, Staphylococcus aureus; identical to SEQ ID NO: 31054
  subsp. aureus IS-111

SEQ ID NO: 38933 - protein, 231 aa, Staphylococcus aureus; identical to SEQ ID NO: 30560
  subsp. aureus IS-111

SEQ ID NO: 38934 - protein, 231 aa, Staphylococcus aureus; identical to SEQ ID NO: 31761
  subsp. aureus IS-111

SEQ ID NO: 38935 - protein, 234 aa, Staphylococcus aureus; identical to SEQ ID NO: 31052
  subsp. aureus IS-111

SEQ ID NO: 38936 - protein, 308 aa, Staphylococcus aureus; identical to SEQ ID NO: 31787
  subsp. aureus IS-111

SEQ ID NO: 38937 - protein, 352 aa, Staphylococcus aureus; identical to SEQ ID NO: 30767
  subsp. aureus IS-111

SEQ ID NO: 38938 - protein, 231 aa, Staphylococcus aureus; identical to SEQ ID NO: 30768
  subsp. aureus IS-111

SEQ ID NO: 38939 - protein, 226 aa, Staphylococcus aureus; identical to SEQ ID NO: 30769
  subsp. aureus IS-111

SEQ ID NO: 38940 - protein, 203 aa, Staphylococcus aureus; identical to SEQ ID NO: 30770
  subsp. aureus IS-111

SEQ ID NO: 38941 - protein, 331 aa, Staphylococcus aureus; identical to SEQ ID NO: 30732
  subsp. aureus IS-111

SEQ ID NO: 38942 - protein, 231 aa, Staphylococcus aureus; identical to SEQ ID NO: 31073
  subsp. aureus IS-111

SEQ ID NO: 38943 - protein, 995 aa, Staphylococcus aureus; identical to SEQ ID NO: 31038
  subsp. aureus IS-111

SEQ ID NO: 38944 - protein, 917 aa, Staphylococcus aureus; identical to SEQ ID NO: 31037
  subsp. aureus IS-111

SEQ ID NO: 38945 - protein, 444 aa, Staphylococcus aureus; identical to SEQ ID NO: 32034
  subsp. aureus IS-111

SEQ ID NO: 38946 - protein, 196 aa, Staphylococcus aureus; identical to SEQ ID NO: 30587
  subsp. aureus IS-111

SEQ ID NO: 38947 - protein, 138 aa, Staphylococcus aureus
  subsp. aureus IS-111
SDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 38948 - protein, 1012 aa, Staphylococcus aureus
  subsp. aureus IS-111
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSD

SEQ ID NO: 38949 - protein, 192 aa, Staphylococcus aureus
  subsp. aureus IS-111
MYSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKKIKIRNK

SEQ ID NO: 38950 - protein, 242 aa, Staphylococcus aureus; identical to SEQ ID NO: 31991
  subsp. aureus IS-111

SEQ ID NO: 38951 - protein, 242 aa, Staphylococcus aureus; identical to SEQ ID NO: 31992
  subsp. aureus IS-111

SEQ ID NO: 38952 - protein, 250 aa, Staphylococcus aureus; identical to SEQ ID NO: 31910
  subsp. aureus IS-111

SEQ ID NO: 38953 - protein, 296 aa, Staphylococcus aureus
  subsp. aureus IS-111
TSCFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 38954 - protein, 233 aa, Staphylococcus aureus
  subsp. aureus IS-111
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILTIYLT

SEQ ID NO: 38955 - protein, 895 aa, Staphylococcus aureus; identical to SEQ ID NO: 30734
  subsp. aureus IS-111

SEQ ID NO: 38956 - protein, 132 aa, Staphylococcus aureus
  subsp. aureus IS-111
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNA

SEQ ID NO: 38957 - protein, 53 aa, Staphylococcus aureus
  subsp. aureus IS-111
MDRYTNFWNQLHWIGNNYKDENRATHTSIYEVDWENHTVKLIDTQSKEKNPMS

SEQ ID NO: 38958 - protein, 238 aa, Staphylococcus aureus; identical to SEQ ID NO: 30740
  subsp. aureus IS-111

SEQ ID NO: 38959 - protein, 241 aa, Staphylococcus aureus; identical to SEQ ID NO: 30739
  subsp. aureus IS-111

SEQ ID NO: 38960 - protein, 241 aa, Staphylococcus aureus; identical to SEQ ID NO: 30738
  subsp. aureus IS-111

SEQ ID NO: 38961 - protein, 2271 aa, Staphylococcus aureus; identical to SEQ ID NO: 32024
  subsp. aureus IS-111

SEQ ID NO: 38962 - protein, 225 aa, Staphylococcus aureus; identical to SEQ ID NO: 30763
  subsp. aureus IS-111

SEQ ID NO: 38963 - protein, 325 aa, Staphylococcus aureus; identical to SEQ ID NO: 30407
  subsp. aureus IS-111

SEQ ID NO: 38964 - protein, 315 aa, Staphylococcus aureus; identical to SEQ ID NO: 30440
  subsp. aureus IS-111

SEQ ID NO: 38965 - protein, 321 aa, Staphylococcus aureus; identical to SEQ ID NO: 30959
  subsp. aureus IS-111

SEQ ID NO: 38966 - protein, 289 aa, Staphylococcus aureus
  subsp. aureus IS-111
MKKIVKSSVVTSIALLLLSNTVDAAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETINYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQREMDRYTNFWNQLHWIHEV

SEQ ID NO: 38967 - protein, 312 aa, Staphylococcus aureus; identical to SEQ ID NO: 30196
  subsp. aureus IS-111

SEQ ID NO: 38968 - protein, 129 aa, Staphylococcus aureus; identical to SEQ ID NO: 33776
  subsp. aureus IS-111

SEQ ID NO: 38969 - protein, 690 aa, Staphylococcus aureus; identical to SEQ ID NO: 31973
  subsp. aureus IS-111

SEQ ID NO: 38970 - protein, 233 aa, Staphylococcus aureus
  subsp. aureus IS-111
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSISYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 38971 - protein, 291 aa, Staphylococcus aureus; identical to SEQ ID NO: 30390
  subsp. aureus IS-111

SEQ ID NO: 38972 - protein, 241 aa, Staphylococcus aureus; identical to SEQ ID NO: 30776
  subsp. aureus IS-111

SEQ ID NO: 38973 - protein, 62 aa, Staphylococcus aureus; identical to SEQ ID NO: 30610
  subsp. aureus IS-122

SEQ ID NO: 38974 - protein, 138 aa, Staphylococcus aureus; identical to SEQ ID NO: 30785
  subsp. aureus IS-122

SEQ ID NO: 38975 - protein, 193 aa, Staphylococcus aureus
  subsp. aureus IS-122
MNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKVRNMDISQNLILGLTKEKLLSI

SEQ ID NO: 38976 - protein, 242 aa, Staphylococcus aureus; identical to SEQ ID NO: 30536
  subsp. aureus IS-122

SEQ ID NO: 38977 - protein, 989 aa, Staphylococcus aureus; identical to SEQ ID NO: 31697
  subsp. aureus IS-122

SEQ ID NO: 38978 - protein, 434 aa, Staphylococcus aureus [sequence omitted]

SEQ ID NO: 38979 - protein, 254 aa, Staphylococcus aureus; identical to SEQ ID NO: 30809
  subsp. aureus IS-122

SEQ ID NO: 38980 - protein, 239 aa, Staphylococcus aureus
  subsp. aureus IS-122
MKRILIIVVLLFCYSQNHIATADVGVLNLRNYYGSYPIEDHQSINPENNHLSHQLVFSMDNSTVTAEFKNVDDVKKFKNHAVDVYGLIYSGYCLKNKYIYGGVTLAGDYLEKSRRIPINLWVNGEHQTISTDKVSTNKKLVTAQEIDTKLRRYLQEEYNIYGFNDTNKGRNYGNKSKFSSGFNAGKILFHLNDGSSFSYDLFDTGTGQAESFLKIYNDNKTVETEKFHLDVEISYKDES

SEQ ID NO: 38981 - protein, 242 aa, Staphylococcus aureus; identical to SEQ ID NO: 30399
  subsp. aureus IS-122

SEQ ID NO: 38982 - protein, 131 aa, Staphylococcus aureus; identical to SEQ ID NO: 30867
  subsp. aureus IS-122

SEQ ID NO: 38983 - protein, 165 aa, Staphylococcus aureus; identical to SEQ ID NO: 30805
  subsp. aureus IS-122

SEQ ID NO: 38984 - protein, 258 aa, Staphylococcus aureus; identical to SEQ ID NO: 30410
  subsp. aureus IS-122

SEQ ID NO: 38985 - protein, 311 aa, Staphylococcus aureus; identical to SEQ ID NO: 30617
  subsp. aureus IS-122

SEQ ID NO: 38986 - protein, 97 aa, Staphylococcus aureus
  subsp. aureus IS-122
MKMKKLVKSSVASSIALLLLSNTVDAAQHITPVSEKKVDDKITLYKTTATSDNDKLNISQILTFNFIKDKSYDKDTLVLKAAGNINSGYKKPNPKDY

SEQ ID NO: 38987 - protein, 291 aa, Staphylococcus aureus; identical to SEQ ID NO: 30390
  subsp. aureus IS-122

SEQ ID NO: 38988 - protein, 227 aa, Staphylococcus aureus; identical to SEQ ID NO: 30586
  subsp. aureus IS-122

SEQ ID NO: 38989 - protein, 61 aa, Staphylococcus aureus; identical to SEQ ID NO: 33840
  subsp. aureus IS-122

SEQ ID NO: 38990 - protein, 157 aa, Staphylococcus aureus; identical to SEQ ID NO: 38930
  subsp. aureus IS-122

SEQ ID NO: 38991 - protein, 232 aa, Staphylococcus aureus; identical to SEQ ID NO: 30584
  subsp. aureus IS-122

SEQ ID NO: 38992 - protein, 232 aa, Staphylococcus aureus; identical to SEQ ID NO: 30583
  subsp. aureus IS-122

SEQ ID NO: 38993 - protein, 231 aa, Staphylococcus aureus; identical to SEQ ID NO: 30582
  subsp. aureus IS-122

SEQ ID NO: 38994 - protein, 234 aa, Staphylococcus aureus; identical to SEQ ID NO: 30581
  subsp. aureus IS-122

SEQ ID NO: 38995 - protein, 292 aa, Staphylococcus aureus; identical to SEQ ID NO: 30580
  subsp. aureus IS-122

SEQ ID NO: 38996 - protein, 356 aa, Staphylococcus aureus; identical to SEQ ID NO: 30793
  subsp. aureus IS-122

SEQ ID NO: 38997 - protein, 231 aa, Staphylococcus aureus; identical to SEQ ID NO: 30578
  subsp. aureus IS-122

SEQ ID NO: 38998 - protein, 226 aa, Staphylococcus aureus; identical to SEQ ID NO: 30577
  subsp. aureus IS-122

SEQ ID NO: 38999 - protein, 91 aa, Staphylococcus aureus; identical to SEQ ID NO: 33329
  subsp. aureus IS-122

SEQ ID NO: 39000 - protein, 681 aa, Staphylococcus aureus; identical to SEQ ID NO: 30598
  subsp. aureus IS-122

SEQ ID NO: 39001 - protein, 2271 aa, Staphylococcus aureus; identical to SEQ ID NO: 30597
  subsp. aureus IS-122

SEQ ID NO: 39002 - protein, 351 aa, Staphylococcus aureus; identical to SEQ ID NO: 30628
  subsp. aureus IS-122

SEQ ID NO: 39003 - protein, 338 aa, Staphylococcus aureus; identical to SEQ ID NO: 30627
  subsp. aureus IS-122

SEQ ID NO: 39004 - protein, 274 aa, Staphylococcus aureus; identical to SEQ ID NO: 30872
  subsp. aureus IS-122

SEQ ID NO: 39005 - protein, 96 aa, Staphylococcus aureus; identical to SEQ ID NO: 30813
  subsp. aureus IS-122

SEQ ID NO: 39006 - protein, 259 aa, Staphylococcus aureus; identical to SEQ ID NO: 30226
  subsp. aureus IS-122

SEQ ID NO: 39007 - protein, 268 aa, Staphylococcus aureus; identical to SEQ ID NO: 30398
  subsp. aureus IS-122

SEQ ID NO: 39008 - protein, 179 aa, Staphylococcus aureus; identical to SEQ ID NO: 30225
  subsp. aureus IS-122

SEQ ID NO: 39009 - protein, 372 aa, Staphylococcus aureus; identical to SEQ ID NO: 30609
  subsp. aureus IS-122

SEQ ID NO: 39010 - protein, 331 aa, Staphylococcus aureus; identical to SEQ ID NO: 30615
  subsp. aureus IS-122

SEQ ID NO: 39011 - protein, 350 aa, Staphylococcus aureus; identical to SEQ ID NO: 30602
  subsp. aureus IS-122

SEQ ID NO: 39012 - protein, 645 aa, Staphylococcus aureus; identical to SEQ ID NO: 30601
  subsp. aureus IS-122

SEQ ID NO: 39013 - protein, 305 aa, Staphylococcus aureus
  subsp. aureus IS-122
HCRSAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWIGNNYKNQNTVTFTSTYEVDWQNHTVKLIGTDSKETNPGV

SEQ ID NO: 39014 - protein, 211 aa, Staphylococcus aureus; identical to SEQ ID NO: 30592
  subsp. aureus IS-122

SEQ ID NO: 39015 - protein, 233 aa, Staphylococcus aureus; identical to SEQ ID NO: 30591
  subsp. aureus IS-122

SEQ ID NO: 39016 - protein, 172 aa, Staphylococcus aureus
  subsp. aureus IS-122
MNSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 39017 - protein, 1196 aa, Staphylococcus aureus
  subsp. aureus IS-122
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDQ

SEQ ID NO: 39018 - protein, 697 aa, Staphylococcus aureus
  subsp. aureus IS-122
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSD

SEQ ID NO: 39019 - protein, 691 aa, Staphylococcus aureus; identical to SEQ ID NO: 30511
  subsp. aureus IS-122

SEQ ID NO: 39020 - protein, 203 aa, Staphylococcus aureus; identical to SEQ ID NO: 30576
  subsp. aureus IS-122

SEQ ID NO: 39021 - protein, 156 aa, Staphylococcus aureus
  subsp. aureus IS-122
SDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 39022 - protein, 51 aa, Staphylococcus aureus; identical to SEQ ID NO: 32234
  subsp. aureus IS-122

SEQ ID NO: 39023 - protein, 972 aa, Staphylococcus aureus
  subsp. aureus IS-122
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDS

SEQ ID NO: 39024 - protein, 448 aa, Staphylococcus aureus
  subsp. aureus IS-122
PVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 39025 - protein, 266 aa, Staphylococcus aureus
  subsp. aureus IS-122
MYKRLFISRVILIFALILVISTPNVLAESQPDPKPDELHKASKFTGLMENMKVLYDDNHVSAINVKSIDQFLYFDLIYSIKDTKLGNYDNVRVEFKNKDLADKYKDKYVDVFGANYYYQCYFSKKTNDINSHQTDKRKTCMYGGVTEHNGNHLDKYRSITVRVFEDGKNLLSFDVQTNKKKVTAQELDYLTRHYLVKNKKLYEFNNSPYETGYIKFIESENSFWYDMMPAPGDKFDQSKNLMMYNDNKLVDSKDVKIEVYLTTKKK

SEQ ID NO: 39026 - protein, 235 aa, Staphylococcus aureus
  subsp. aureus IS-122
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPIDSV

SEQ ID NO: 39027 - protein, 2186 aa, Staphylococcus aureus; identical to SEQ ID NO: 30516
  subsp. aureus IS-122

SEQ ID NO: 39028 - protein, 891 aa, Staphylococcus aureus; identical to SEQ ID NO: 30788
  subsp. aureus IS-122

SEQ ID NO: 39029 - protein, 938 aa, Staphylococcus aureus; identical to SEQ ID NO: 30838
  subsp. aureus IS-122

SEQ ID NO: 39030 - protein, 1015 aa, Staphylococcus aureus; identical to SEQ ID NO: 30839
  subsp. aureus IS-122

SEQ ID NO: 39031 - protein, 543 aa, Staphylococcus aureus
  subsp. aureus IS-122
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDS

SEQ ID NO: 39032 - protein, 241 aa, Staphylococcus aureus; identical to SEQ ID NO: 30571
  subsp. aureus IS-122

SEQ ID NO: 39033 - protein, 809 aa, Staphylococcus aureus
  subsp. aureus IS-122
MTYRMKKWQKLSTITLLMAGVITLNGGEFRSIDKHQIAVADTNVQTPDYEKLRNTWLDVNYGYDKYDEKNDAMKKKFDATEKEAEKLLSSMKTESGRTYLWDSAKDLDNKSADMTRTYRNIEKIAEAMRHPKTTLNTDENKKKVKDALEWLHKNAYGKEPDNKVKELTENFKITDSSKKKALNWWDYEIGTPRSLTNTLILLNDQFSNEEKKKFTAPIKTFAPKSDEILSSVGKAEPAKGGNLVDIAKVKLLESIIEEDKDMMKNSIDSFNKVFTYVQDSATDKERNGFYKDGSYIDHKDVPYTGAYGVILLEGISQMMPMIKETPFNDKTQNNTTLKSWIDDGFLPLIYKGEMMDLSRGRAISRENETSHSASATVMKSLLRLSDAMDDSTKAKYKKIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSNSTQTFDINNTKVEVKAKGMFILKNKDDNTYECSFYNPESTNTASDIESKISITGYSITNKNTSTSNESGVHFELTK

SEQ ID NO: 39034 - protein, 141 aa, Staphylococcus aureus; identical to SEQ ID NO: 30633
  subsp. aureus IS-122

SEQ ID NO: 39035 - protein, 319 aa, Staphylococcus aureus; identical to SEQ ID NO: 30605
  subsp. aureus IS-122

SEQ ID NO: 39036 - protein, 238 aa, Staphylococcus aureus; identical to SEQ ID NO: 30606
  subsp. aureus IS-122

SEQ ID NO: 39037 - protein, 241 aa, Staphylococcus aureus; identical to SEQ ID NO: 30607
  subsp. aureus IS-122

SEQ ID NO: 39038 - protein, 241 aa, Staphylococcus aureus; identical to SEQ ID NO: 30608
  subsp. aureus IS-122

SEQ ID NO: 39039 - protein, 792 aa, Staphylococcus aureus
  subsp. aureus IS-122
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPKTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDS

SEQ ID NO: 39040 - protein, 2481 aa, Staphylococcus aureus; identical to SEQ ID NO: 31413
  subsp. aureus IS-122

SEQ ID NO: 39041 - protein, 231 aa, Staphylococcus aureus; identical to SEQ ID NO: 30630
  subsp. aureus IS-122

SEQ ID NO: 39042 - protein, 270 aa, Staphylococcus aureus
  subsp. aureus IS-122
KFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39043 - protein, 165 aa, Staphylococcus aureus; identical to SEQ ID NO: 30418
  subsp. aureus IS-122

SEQ ID NO: 39044 - protein, 54 aa, Staphylococcus aureus; identical to SEQ ID NO: 34430
  subsp. aureus IS-122

SEQ ID NO: 39045 - protein, 325 aa, Staphylococcus aureus; identical to SEQ ID NO: 30407
  subsp. aureus IS-122

SEQ ID NO: 39046 - protein, 315 aa, Staphylococcus aureus; identical to SEQ ID NO: 30573
  subsp. aureus IS-122

SEQ ID NO: 39047 - protein, 321 aa, Staphylococcus aureus; identical to SEQ ID NO: 30959
  subsp. aureus IS-122

SEQ ID NO: 39048 - protein, 831 aa, Staphylococcus aureus
  subsp. aureus IS-125
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSESDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 39049 - protein, 372 aa, Staphylococcus aureus
  subsp. aureus IS-125
KDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 39050 - protein, 165 aa, Staphylococcus aureus; identical to SEQ ID NO: 30742
  subsp. aureus IS-125

SEQ ID NO: 39051 - protein, 1229 aa, Staphylococcus aureus
  subsp. aureus IS-125
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDTDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSD

SEQ ID NO: 39052 - protein, 51 aa, Staphylococcus aureus; identical to SEQ ID NO: 32614
  subsp. aureus IS-125

SEQ ID NO: 39053 - protein, 1805 aa, Staphylococcus aureus
  subsp. aureus IS-125
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKNQLQQIYMLMQIRRKIIFQLTLMQHKMKSNKQLSKLTKMFKLH

SEQ ID NO: 39054 - protein, 684 aa, Staphylococcus aureus
  subsp. aureus IS-125
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGTKKVIDLKAGIYTADLINTSEIKAININVDTKKQVEDKKKDKANYQVPYTITVNGTSQNILSNLTFNKNQNISYKDLEDRVKSVLESNRGITDVDLRLSKQAKYTVNFKNGTKKVIDLKSGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADRYVPYTIAVNGTSTPILSDLKFTGDPRVGYKDISKKVKSVLKHDRGIGERELKYAKKATYTVHFKNGTKKVININSNISQLNLLYVQDIKKIDIDVKTGTKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKINKSNNVKFPVTINKFENIVSNEFVFYNASKITINDLSIKLKSAMANDQGITKHDIGLAERAVYKVYFKNGSSKYVDLKTEYKDERVFKATDIKKVDIELKF

SEQ ID NO: 39055 - protein, 327 aa, Staphylococcus aureus; identical to SEQ ID NO: 30538
  subsp. aureus IS-125

SEQ ID NO: 39056 - protein, 311 aa, Staphylococcus aureus; identical to SEQ ID NO: 30617
  subsp. aureus IS-125

SEQ ID NO: 39057 - protein, 231 aa, Staphylococcus aureus; identical to SEQ ID NO: 31073
  subsp. aureus IS-125

SEQ ID NO: 39058 - protein, 829 aa, Staphylococcus aureus
  subsp. aureus IS-125
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTTLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKLQEMQLTKQQQRKDNK

SEQ ID NO: 39059 - protein, 807 aa, Staphylococcus aureus; identical to SEQ ID NO: 30716
  subsp. aureus IS-125

SEQ ID NO: 39060 - protein, 141 aa, Staphylococcus aureus; identical to SEQ ID NO: 30715
  subsp. aureus IS-125

SEQ ID NO: 39061 - protein, 820 aa, Staphylococcus aureus
  subsp. aureus IS-125
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDRRFGLKT

SEQ ID NO: 39062 - protein, 193 aa, Staphylococcus aureus
  subsp. aureus IS-125
MLRGQEERKYSIRKYSIGVVSVLAATMFVVTSHEAQASEKIPTTNAAAQKETLNQPGEQGNAITSHQMQSGKQLDDMHKENGKSGTVTEGKDMLQSSKHQSTQNSKIIRTQNDNQVKQDSERQGSKQSHQNNATNKTERQNDQIQNTHHAERNGSQSTTSQSNDVDKSQPSIPAQKVIPNHDKAAPTSTTPPI

SEQ ID NO: 39063 - protein, 227 aa, Staphylococcus aureus; identical to SEQ ID NO: 30585
  subsp. aureus IS-125

SEQ ID NO: 39064 - protein, 232 aa, Staphylococcus aureus; identical to SEQ ID NO: 30765
  subsp. aureus IS-125

SEQ ID NO: 39065 - protein, 146 aa, Staphylococcus aureus
  subsp. aureus IS-125
MGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 39066 - protein, 231 aa, Staphylococcus aureus; identical to SEQ ID NO: 30560
  subsp. aureus IS-125

SEQ ID NO: 39067 - protein, 231 aa, Staphylococcus aureus; identical to SEQ ID NO: 31761
  subsp. aureus IS-125

SEQ ID NO: 39068 - protein, 234 aa, Staphylococcus aureus; identical to SEQ ID NO: 31052
  subsp. aureus IS-125

SEQ ID NO: 39069 - protein, 308 aa, Staphylococcus aureus; identical to SEQ ID NO: 31787
  subsp. aureus IS-125

SEQ ID NO: 39070 - protein, 352 aa, Staphylococcus aureus; identical to SEQ ID NO: 30767
  subsp. aureus IS-125

SEQ ID NO: 39071 - protein, 231 aa, Staphylococcus aureus; identical to SEQ ID NO: 30768
  subsp. aureus IS-125

SEQ ID NO: 39072 - protein, 226 aa, Staphylococcus aureus; identical to SEQ ID NO: 30769
  subsp. aureus IS-125

SEQ ID NO: 39073 - protein, 915 aa, Staphylococcus aureus; identical to SEQ ID NO: 36147
  subsp. aureus IS-125

SEQ ID NO: 39074 - protein, 434 aa, Staphylococcus aureus [sequence omitted]

SEQ ID NO: 39075 - protein, 895 aa, Staphylococcus aureus; identical to SEQ ID NO: 30734
  subsp. aureus IS-125

SEQ ID NO: 39076 - protein, 125 aa, Staphylococcus aureus; identical to SEQ ID NO: 33215
  subsp. aureus IS-125

SEQ ID NO: 39077 - protein, 917 aa, Staphylococcus aureus; identical to SEQ ID NO: 31037
  subsp. aureus IS-125

SEQ ID NO: 39078 - protein, 995 aa, Staphylococcus aureus; identical to SEQ ID NO: 31038
  subsp. aureus IS-125

SEQ ID NO: 39079 - protein, 233 aa, Staphylococcus aureus; identical to SEQ ID NO: 31039
  subsp. aureus IS-125

SEQ ID NO: 39080 - protein, 274 aa, Staphylococcus aureus; identical to SEQ ID NO: 30872
  subsp. aureus IS-125

SEQ ID NO: 39081 - protein, 338 aa, Staphylococcus aureus; identical to SEQ ID NO: 30699
  subsp. aureus IS-125

SEQ ID NO: 39082 - protein, 321 aa, Staphylococcus aureus
  subsp. aureus IS-125
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKIKMVKD

SEQ ID NO: 39083 - protein, 331 aa, Staphylococcus aureus; identical to SEQ ID NO: 30732
  subsp. aureus IS-125

SEQ ID NO: 39084 - protein, 203 aa, Staphylococcus aureus; identical to SEQ ID NO: 30770
  subsp. aureus IS-125

SEQ ID NO: 39085 - protein, 291 aa, Staphylococcus aureus; identical to SEQ ID NO: 33009
  subsp. aureus IS-125

SEQ ID NO: 39086 - protein, 1759 aa, Staphylococcus aureus; identical to SEQ ID NO: 31045
  subsp. aureus IS-125

SEQ ID NO: 39087 - protein, 681 aa, Staphylococcus aureus; identical to SEQ ID NO: 31046
  subsp. aureus IS-125

SEQ ID NO: 39088 - protein, 333 aa, Staphylococcus aureus
  subsp. aureus IS-125
MERQKVTWSNLPENDKNGKTIKYLVKEVNAQGKDTTPEGYTKKEDGLVVTNTEKPIETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 39089 - protein, 321 aa, Staphylococcus aureus; identical to SEQ ID NO: 30959
  subsp. aureus IS-125

SEQ ID NO: 39090 - protein, 315 aa, Staphylococcus aureus; identical to SEQ ID NO: 30440
  subsp. aureus IS-125

SEQ ID NO: 39091 - protein, 325 aa, Staphylococcus aureus; identical to SEQ ID NO: 30407
  subsp. aureus IS-125

SEQ ID NO: 39092 - protein, 250 aa, Staphylococcus aureus; identical to SEQ ID NO: 31910
  subsp. aureus IS-125

SEQ ID NO: 39093 - protein, 109 aa, Staphylococcus aureus; identical to SEQ ID NO: 30744
  subsp. aureus IS-125

SEQ ID NO: 39094 - protein, 350 aa, Staphylococcus aureus
  subsp. aureus IS-125
MTKHYLNSKYQSEQRSSATKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 39095 - protein, 645 aa, Staphylococcus aureus; identical to SEQ ID NO: 30747
  subsp. aureus IS-125

SEQ ID NO: 39096 - protein, 225 aa, Staphylococcus aureus; identical to SEQ ID NO: 30763
  subsp. aureus IS-125

SEQ ID NO: 39097 - protein, 372 aa, Staphylococcus aureus; identical to SEQ ID NO: 31084
  subsp. aureus IS-125

SEQ ID NO: 39098 - protein, 200 aa, Staphylococcus aureus
  subsp. aureus IS-125
MKKNIMNKLVLSTALLLLETTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKIKSYITENLIKVKLR

SEQ ID NO: 39099 - protein, 241 aa, Staphylococcus aureus; identical to SEQ ID NO: 30739
  subsp. aureus IS-125

SEQ ID NO: 39100 - protein, 238 aa, Staphylococcus aureus; identical to SEQ ID NO: 30740
  subsp. aureus IS-125

SEQ ID NO: 39101 - protein, 319 aa, Staphylococcus aureus
  subsp. aureus IS-125
MKTHIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKLGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 39102 - protein, 51 aa, Staphylococcus aureus; identical to SEQ ID NO: 32222
  subsp. aureus IS-125

SEQ ID NO: 39103 - protein, 985 aa, Staphylococcus aureus
  subsp. aureus IS-125
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSD

SEQ ID NO: 39104 - protein, 51 aa, Staphylococcus aureus; identical to SEQ ID NO: 32234
  subsp. aureus IS-125

SEQ ID NO: 39105 - protein, 254 aa, Staphylococcus aureus
  subsp. aureus IS-125
PNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39106 - protein, 166 aa, Staphylococcus aureus
  subsp. aureus IS-125
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSANLLAEAKKLNESQAPKADNKFNKEQQNAF

SEQ ID NO: 39107 - protein, 221 aa, Staphylococcus aureus; identical to SEQ ID NO: 31036
  subsp. aureus IS-125

SEQ ID NO: 39108 - protein, 257 aa, Staphylococcus aureus; identical to SEQ ID NO: 30259
  subsp. aureus IS-125

SEQ ID NO: 39109 - protein, 299 aa, Staphylococcus aureus
  subsp. aureus IS-157
IPFKKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 39110 - protein, 321 aa, Staphylococcus aureus; identical to SEQ ID NO: 39082
  subsp. aureus IS-157

SEQ ID NO: 39111 - protein, 338 aa, Staphylococcus aureus; identical to SEQ ID NO: 30699
  subsp. aureus IS-157

SEQ ID NO: 39112 - protein, 274 aa, Staphylococcus aureus; identical to SEQ ID NO: 30872
  subsp. aureus IS-157

SEQ ID NO: 39113 - protein, 291 aa, Staphylococcus aureus; identical to SEQ ID NO: 33009
  subsp. aureus IS-157

SEQ ID NO: 39114 - protein, 240 aa, Staphylococcus aureus; identical to SEQ ID NO: 38382
  subsp. aureus IS-157

SEQ ID NO: 39115 - protein, 225 aa, Staphylococcus aureus; identical to SEQ ID NO: 30763
  subsp. aureus IS-157

SEQ ID NO: 39116 - protein, 666 aa, Staphylococcus aureus
  subsp. aureus IS-157
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDS

SEQ ID NO: 39117 - protein, 164 aa, Staphylococcus aureus
  subsp. aureus IS-157
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSANLLAEAKKLNDAQAPKLTTNSTKNNKM

SEQ ID NO: 39118 - protein, 226 aa, Staphylococcus aureus; identical to SEQ ID NO: 30769
  subsp. aureus IS-157

SEQ ID NO: 39119 - protein, 231 aa, Staphylococcus aureus; identical to SEQ ID NO: 30768
  subsp. aureus IS-157

SEQ ID NO: 39120 - protein, 125 aa, Staphylococcus aureus; identical to SEQ ID NO: 33215
  subsp. aureus IS-157

SEQ ID NO: 39121 - protein, 917 aa, Staphylococcus aureus; identical to SEQ ID NO: 31037
  subsp. aureus IS-157

SEQ ID NO: 39122 - protein, 995 aa, Staphylococcus aureus; identical to SEQ ID NO: 31038
  subsp. aureus IS-157

SEQ ID NO: 39123 - protein, 233 aa, Staphylococcus aureus; identical to SEQ ID NO: 31039
  subsp. aureus IS-157

SEQ ID NO: 39124 - protein, 165 aa, Staphylococcus aureus; identical to SEQ ID NO: 30742
  subsp. aureus IS-157

SEQ ID NO: 39125 - protein, 895 aa, Staphylococcus aureus; identical to SEQ ID NO: 30734
  subsp. aureus IS-157

SEQ ID NO: 39126 - protein, 200 aa, Staphylococcus aureus
  subsp. aureus IS-157
EVAQISDYYPRNSIDTKEYMSTLTYGFNGNVTGDDTGKIGGLIGANVSIGHTLKYVQPDFKTILESPTDKKLGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 39127 - protein, 1157 aa, Staphylococcus aureus
  subsp. aureus IS-157
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDTDSDSDRDSDSDSDSDSDSDSDSDSD

SEQ ID NO: 39128 - protein, 141 aa, Staphylococcus aureus
  subsp. aureus IS-157
DSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 39129 - protein, 996 aa, Staphylococcus aureus
  subsp. aureus IS-157
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDS

SEQ ID NO: 39130 - protein, 137 aa, Staphylococcus aureus
  subsp. aureus IS-157
DSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 39131 - protein, 231 aa, Staphylococcus aureus; identical to SEQ ID NO: 31073
  subsp. aureus IS-157

SEQ ID NO: 39132 - protein, 325 aa, Staphylococcus aureus; identical to SEQ ID NO: 30407
  subsp. aureus IS-157

SEQ ID NO: 39133 - protein, 315 aa, Staphylococcus aureus; identical to SEQ ID NO: 30440
  subsp. aureus IS-157

SEQ ID NO: 39134 - protein, 321 aa, Staphylococcus aureus; identical to SEQ ID NO: 30959
  subsp. aureus IS-157

SEQ ID NO: 39135 - protein, 108 aa, Staphylococcus aureus
  subsp. aureus IS-157
SDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 39136 - protein, 689 aa, Staphylococcus aureus
  subsp. aureus IS-157
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYINPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDS

SEQ ID NO: 39137 - protein, 78 aa, Staphylococcus aureus
  subsp. aureus IS-157
MNKQQSKVRYSIRKVSIGILSISIGMFLALGMSNKAYADEIDKSKDFTRGYEQNVFAKSELNANKNTTKDKIKNRRCC

SEQ ID NO: 39138 - protein, 250 aa, Staphylococcus aureus; identical to SEQ ID NO: 31910
  subsp. aureus IS-157

SEQ ID NO: 39139 - protein, 350 aa, Staphylococcus aureus; identical to SEQ ID NO: 39094
  subsp. aureus IS-157

SEQ ID NO: 39140 - protein, 677 aa, Staphylococcus aureus
  subsp. aureus IS-157
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKTNKSSLYLIIKLTNFNWRMRYPVTSFANYFFTI

SEQ ID NO: 39141 - protein, 645 aa, Staphylococcus aureus; identical to SEQ ID NO: 35633
  subsp. aureus IS-157

SEQ ID NO: 39142 - protein, 227 aa, Staphylococcus aureus; identical to SEQ ID NO: 30585
  subsp. aureus IS-157

SEQ ID NO: 39143 - protein, 232 aa, Staphylococcus aureus; identical to SEQ ID NO: 30765
  subsp. aureus IS-157

SEQ ID NO: 39144 - protein, 68 aa, Staphylococcus aureus; identical to SEQ ID NO: 38389
  subsp. aureus IS-157

SEQ ID NO: 39145 - protein, 231 aa, Staphylococcus aureus; identical to SEQ ID NO: 30560
  subsp. aureus IS-157

SEQ ID NO: 39146 - protein, 231 aa, Staphylococcus aureus; identical to SEQ ID NO: 31761
  subsp. aureus IS-157

SEQ ID NO: 39147 - protein, 234 aa, Staphylococcus aureus; identical to SEQ ID NO: 31052
  subsp. aureus IS-157

SEQ ID NO: 39148 - protein, 308 aa, Staphylococcus aureus; identical to SEQ ID NO: 31787
  subsp. aureus IS-157

SEQ ID NO: 39149 - protein, 352 aa, Staphylococcus aureus; identical to SEQ ID NO: 30767
  subsp. aureus IS-157

SEQ ID NO: 39150 - protein, 331 aa, Staphylococcus aureus; identical to SEQ ID NO: 30732
  subsp. aureus IS-157

SEQ ID NO: 39151 - protein, 2186 aa, Staphylococcus aureus
  subsp. aureus IS-157
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTTLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 39152 - protein, 2478 aa, Staphylococcus aureus
  subsp. aureus IS-157
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKENNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 39153 - protein, 311 aa, Staphylococcus aureus; identical to SEQ ID NO: 30617
  subsp. aureus IS-157

SEQ ID NO: 39154 - protein, 327 aa, Staphylococcus aureus; identical to SEQ ID NO: 30538
  subsp. aureus IS-157

SEQ ID NO: 39155 - protein, 170 aa, Staphylococcus aureus
  subsp. aureus IS-157
SNSDSDSDSDSDSDSDSDSDSDSNSDSESDSDSDSDSDSDSDSDSDSESDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 39156 - protein, 96 aa, Staphylococcus aureus; identical to SEQ ID NO: 30813
  subsp. aureus IS-157

SEQ ID NO: 39157 - protein, 109 aa, Staphylococcus aureus; identical to SEQ ID NO: 30744
  subsp. aureus IS-157

SEQ ID NO: 39158 - protein, 749 aa, Staphylococcus aureus
  subsp. aureus IS-157
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSD

SEQ ID NO: 39159 - protein, 807 aa, Staphylococcus aureus; identical to SEQ ID NO: 30716
  subsp. aureus IS-157

SEQ ID NO: 39160 - protein, 141 aa, Staphylococcus aureus; identical to SEQ ID NO: 30715
  subsp. aureus IS-157

SEQ ID NO: 39161 - protein, 257 aa, Staphylococcus aureus; identical to SEQ ID NO: 30259
  subsp. aureus IS-157

SEQ ID NO: 39162 - protein, 287 aa, Staphylococcus aureus
  subsp. aureus IS-157
LAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39163 - protein, 190 aa, Staphylococcus aureus; identical to SEQ ID NO: 30534
  subsp. aureus IS-157

SEQ ID NO: 39164 - protein, 164 aa, Staphylococcus aureus
  subsp. aureus IS-157
MKTHIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGA

SEQ ID NO: 39165 - protein, 238 aa, Staphylococcus aureus; identical to SEQ ID NO: 30740
  subsp. aureus IS-157

SEQ ID NO: 39166 - protein, 241 aa, Staphylococcus aureus; identical to SEQ ID NO: 30739
  subsp. aureus IS-157

SEQ ID NO: 39167 - protein, 241 aa, Staphylococcus aureus; identical to SEQ ID NO: 30738
  subsp. aureus IS-157

SEQ ID NO: 39168 - protein, 221 aa, Staphylococcus aureus; identical to SEQ ID NO: 31036
  subsp. aureus IS-157

SEQ ID NO: 39169 - protein, 1759 aa, Staphylococcus aureus; identical to SEQ ID NO: 31045
  subsp. aureus IS-157

SEQ ID NO: 39170 - protein, 681 aa, Staphylococcus aureus; identical to SEQ ID NO: 31046
  subsp. aureus IS-157

SEQ ID NO: 39171 - protein, 809 aa, Staphylococcus aureus; identical to SEQ ID NO: 31961
  subsp. aureus IS-157

SEQ ID NO: 39172 - protein, 203 aa, Staphylococcus aureus; identical to SEQ ID NO: 30770
  subsp. aureus IS-157

SEQ ID NO: 39173 - protein, 203 aa, Staphylococcus aureus
  subsp. aureus IS-160
MFKKHHSKNSIVLKSILSLGIIYGGTFGIYPKADASTQNSSSVQDKQFQKVEEVPNNSEKALVKKLYDRYSKNTINGKSNKSRNWVYSERPLNGNQVRIHLEGTYTVAGRVYTPKRNITLNKEVVTLKELDHIIRFAHISYGLYMGEHLPKGNIVINTKNGGKYTLESHKELQKNRENVEINTADVENVTFDLVKSVNDIEQV

SEQ ID NO: 39174 - protein, 226 aa, Staphylococcus aureus
  subsp. aureus IS-160
MKFKAIAKASLALGMLATGVITSNTQSVQAKTEVKQQSESELKHYYNKPILERKNVTGYKYTEHGKDYIDVIVDNQYSQIALLGSDKDKFKDGENSNIDVFILREGDSRQATNYSIGGVTKSNSVQYIDYINTPILEIKKGNEDVLKDFYYISKEDISLKELDYRLRERAIKQHGLYSNGLKQGQITITMNDGTTHTIDLSQKLEKERMGESIDGTKINKILVEIK

SEQ ID NO: 39175 - protein, 354 aa, Staphylococcus aureus
  subsp. aureus IS-160
MTKHYLNSKYQSEQRSSAMKKITMGTASIILGSLVYIGADSQQVNAATEATNATNNQNAQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKQNEVHKQGPSKDSKAKELPKTGLTSVDNFISTVAFATLALLGSLSLLLFKRKESK

SEQ ID NO: 39176 - protein, 641 aa, Staphylococcus aureus
  subsp. aureus IS-160
MNKQQKEFKSFYSIRKSSIGVASVAISTLLLLMSNGEAQAAEETGGTNTEAQPKTEAVASPSTTTEKAPEAKPVANAVSVSNKEVEAPTSETKEAKEVKAPKETKEVKPAAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANADKSNKKEQQDNSAKKETTPAKPSKPTPSPVEKESQKQDSQKDDNTQSPSVEKENDSSSESGKDKTPATKPAKAEVESSSTTPTKVVSTTQNVAKPTTASSETTKDVVQTSAGSSEAKDSAPLQKANIKNTNDGHTQSQNNKNTQENKAKSLPQTGEESNKDMTLPLMVLLALSSIVAFVLPRKRKN

SEQ ID NO: 39177 - protein, 180 aa, Staphylococcus aureus
  subsp. aureus IS-160
MKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEAQRNGFIQSLKDDPSQSTNVLGEAKKLNESQASKADNNFNKEQQNAFYEILNMPNLNEEQR

SEQ ID NO: 39178 - protein, 903 aa, Staphylococcus aureus
  subsp. aureus IS-160
MKNNLRYGIRKHKLGAASVFLGTMIVVGMGQDKEAAASEQKTTTVEENGNSATDNKVSETQTTATNVNHIEETQSYNATVTEQPSNATQVTTQEVPKAVQAPLTAQPANVETVKEEVVKEEAKPQVKETTQPQDNSGDQRQVDLTPKKATQNQAAETQVEVAQPRTASESKPRVTRSADVVDASDAKVETGTDVTSKVTVEDESKIEAPKGNNVQPHEGQRVVLKYKLKFQDGLKTGDYFDFTLSNNVNTHGVSTTRKVPDIKNGSLVMAKGQVLDNGRIRYTFIDYIKDKVNVTANLEINLFIDPKTVQSNGQQTITSKLNGKETSGTMQITYKDGVKNHYTNVNGSIETFDKEKNKFTHVAYIKPINGNNSDSVTVTGMLTQGSNENGTQPNVKIYEYVGTENGLPQSVYANTVDSTQLKDVTNQMSDKLKVQNNGSYSLNFDKLDKTYVIHYTGDYLNGTSEVNFRTQLTGYPENHYKTYYYYNHGYTLTWDNGLVLYSNKANGDGKYGPIVDSNNFEFSEDSGNGSISGQYDEKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVTDHTTVEDTKEYTTESNLIELVDELPEEHGQAQGPIEEITENNHHISHSGLGTENGHGNYGVVEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHNEIIEEDTNKDKPNYQFGGHNSVDFEEDTLPKVSGQNEGQQTIEEDTTPPTPPTPEVPSEPETPTPPTPEVPSEPEHQ

SEQ ID NO: 39179 - protein, 351 aa, Staphylococcus aureus; identical to SEQ ID NO: 34699
  subsp. aureus IS-160

SEQ ID NO: 39180 - protein, 338 aa, Staphylococcus aureus
  subsp. aureus IS-160
MIKQLYKNITICSLAISTVLTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDEGKSKFVVHYKRSMDEFKIDWNRHGFWGYWSGENHVDKKEEKLSALYEVDWKTHDVKFVKVLNDNEKK

SEQ ID NO: 39181 - protein, 330 aa, Staphylococcus aureus; identical to SEQ ID NO: 30381
  subsp. aureus IS-160

SEQ ID NO: 39182 - protein, 96 aa, Staphylococcus aureus
  subsp. aureus IS-160
MKFPVTINKFENIVSNEFVFYNASKITINDLSIKLKSAMANDQGITKHDIGLAERAVYKVYFKNGSSKYVDLKTEYKDGKVFKATDIKKVDIELKF

SEQ ID NO: 39183 - protein, 241 aa, Staphylococcus aureus; identical to SEQ ID NO: 34651
  subsp. aureus IS-160

SEQ ID NO: 39184 - protein, 241 aa, Staphylococcus aureus; identical to SEQ ID NO: 34650
  subsp. aureus IS-160

SEQ ID NO: 39185 - protein, 238 aa, Staphylococcus aureus; identical to SEQ ID NO: 34649
  subsp. aureus IS-160

SEQ ID NO: 39186 - protein, 206 aa, Staphylococcus aureus; identical to SEQ ID NO: 34848
  subsp. aureus IS-160

SEQ ID NO: 39187 - protein, 959 aa, Staphylococcus aureus
  subsp. aureus IS-160
MNMKKKEKHAIRKKSIGVASVLVGTLIGFGLLSSKEADASENSVTQSDSASNESKSNDSSSVNAAPKTDNTNVSDTKTTSNTNNGETSVAQYLAQQETTQSVSTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDNDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFPTDDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSDSDSDSASDSDSASDSDSASDSTSDSDSDSASDSDSASDSDSASDSDSDSDSDSDNDSDSDSDSDSDSDSDSESDSDSDSDSDSDSDSDSDSDSDSDSDSDSDSDSDSDSDLDSDSDSDSDSDSDSDSDSDSDSDSDSDSDSDSDSDSDSDSDSDSDSDSDSDSDSDSDSDSDSASDSDSDSDSDSDSDSDSDSDSESDSDSDSVSDSDSDSDSDSDSNSESDSDSDSDSDSDSASDSDSGSDSDSDSDSDSDSDSDSDSDSDSTSDSDSDSTSDTGSDNDSDSESDSNSDSDSGSNNNVVPPNSPKNGTNASNKNEAKDSKEPLPDTGSEGEENTSLIWGLLASLGSLLLFRRKKKIKIRNK

SEQ ID NO: 39188 - protein, 434 aa, Staphylococcus aureus [sequence omitted]

SEQ ID NO: 39189 - protein, 291 aa, Staphylococcus aureus
  subsp. aureus IS-160
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSYTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 39190 - protein, 1199 aa, Staphylococcus aureus
  subsp. aureus IS-160
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNNDVVSNNTTLNVPNKTNENGSGGHLTLKEIQEDVRHSSDKPELVAIAEQASNRPKKRSRRAAPADPNATPADPAAAAANGTASAGNTATYTPTTDPNGNNVGQNAPNEVLSFDDNSIRPSTNRSVPSVTVVDNLPGFTLINGGKVGVLSHAMVRTNMFQAGSNRTYQAQGNVLALGRISGTDTSNHGDFNGIEKSLTVNPNSELIFEFNTMPTKNGQGATNVIIKNGATNDTIAEKTIEDGPTLRLFKVPDNVNSLKIQFVPKNDAITDANGIYQLKDGYKYYSFVDSIGLHSGSHVYVERRTMEPTATNNKEFTVTTSLKNNGNSGASFDTDEFVYKIQLPEGVEYVNNSLTKDFPSSNSGVDMNDFNVTYDAANRVITIKSTGGGTANSPARLMPDKILDLKYKLRVNNVPTPRKVTFNDTLTYKTYTQDFINSPAESHTVSTNPYTIDIIMNKDALQGEVDRRIQQADYTFASLDIFNALKRRAQTILDENRNNVPLDQRVSQADIDTLTNQMQHTLIRSVDDENAVNQKADQMQDLINQNDELTDEEKQAANQIIEEHKGNIIGDIGDQTTGDGVTRIKDQGIQTLSGDTATPVVKPNAKKAIRDKAAKQREIINNTPDATQDEIQDALNQLTTDETDAIDNVTNATTNDDVETAKNNGINTIGAVVPQVTHKQAARDAINQATATKRQQINNNREATQEEKNAALNELTQATNHALEQINQATTNADVDNAKGDGLNAINPIAPVTVVKQAARDAVSHDVQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAIDRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKNLQH

SEQ ID NO: 39191 - protein, 895 aa, Staphylococcus aureus
  subsp. aureus IS-160
MNKHHPKLRSFYSIRKSTLGVASVIVSTLFLITSQHQAQAAENTNTSDKISENQNNNATTTQPPKDTNQTQPATQPANTAKTYPVADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDSSLVKSDTNDAVATNDQSSSDASNQTNTNISNQNTSTTNNTSDQPQTTTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYMPDKAVYNAIVKVVVANIGYEGQYHVRIINQDIKTKDEDTSQNNTSEPLNVQTGQEDKVSDTDIAENSSTATNPKDASDKADVIEPESDMVKDADNNIDKDVQHDVDHLSDMSDNNHFDKYDLKEMDTQIAKDTDKGVDNSVGMSSNVDTDKDSNKNKDKVIQMDHIADKNKVNNNTGTETNIDTMQYHPISTIKVTDKKTTEHLPSDIHKTVDKTVKAKEKAGTPSKENKLSQSKMLPKTGETTSSQSWWGLYALLGMLALFIPKFKKNLNN

SEQ ID NO: 39192 - protein, 211 aa, Staphylococcus aureus
  subsp. aureus IS-160
MKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTTNNSAVNPSIKANDIHTKSNKQMAKQQSIHLDSKSKSVHKQQLKELPKTGVNNESNTAIMALFIGLILLVVSLVTRFIKLNSYQ

SEQ ID NO: 39193 - protein, 250 aa, Staphylococcus aureus
  subsp. aureus IS-160
MGEFEVKYLTGFILILLLEGILTNSASAIAYSDLHHKSKFNSKRLSNAKMSFANPTDLENKKTNDRLLTHDLLFHDMFLNDAWKKDFKVEFENEALSNEFINKNIDIYTGSYSYECHGGATNKTQCSYGGVTLSDNNKYDDYKNIPCNLWIDGHQTEKELTAVKTKKKIVTIQELDVQLRNYLNEKYKLYEKGGDIVKGYVKYHNDDEKNVEYDFYNLNGEYGHEVLKMYADNKTINSDKLHLDIYLFKS

SEQ ID NO: 39194 - protein, 691 aa, Staphylococcus aureus
  subsp. aureus IS-160
MLRGQEERKYSIRKYSIGVVSVLAATMFIVSSHEAQASEKTLTSNAAAQKETLNQPGEQGNAITSHQMQSGKQLDDMHKENGKSGTVTEGKDTLQSSKHQSTQNSKTSRTQNDNQVKQDSERQGSKQSHQNNATNKTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATEGKGTQLKAS

SEQ ID NO: 39195 - protein, 264 aa, Staphylococcus aureus
  subsp. aureus IS-160
TFTYLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNNKPGKEDGNKPGKEDGNKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39196 - protein, 266 aa, Staphylococcus aureus; identical to SEQ ID NO: 30401
  subsp. aureus IS-160

SEQ ID NO: 39197 - protein, 242 aa, Staphylococcus aureus; identical to SEQ ID NO: 30537
  subsp. aureus IS-160

SEQ ID NO: 39198 - protein, 242 aa, Staphylococcus aureus
  subsp. aureus IS-160
MKKLISILLINIIILGVSNSASAQGDIGIDNLRNFYTKKDFVDLKDVKDNDTPIANQLQFSNESYDLISESKDFNKFSNFKGKKLDVFGISYNGQCNTKYIYGGVTATNEYLDKSRNIPINIWINGNHKTISTNKVSTNKKFVAAQEIDVKLRKYLQEEYNIYGHNGTKKGEEYGHKSKFYSGFNIGKVTFHLNNNDTFSYDLFYTGDDGLPKSFLKIYEDNKTVESEKFHLDVDISYKETI

SEQ ID NO: 39199 - protein, 141 aa, Staphylococcus aureus; identical to SEQ ID NO: 31189
  subsp. aureus IS-160

SEQ ID NO: 39200 - protein, 807 aa, Staphylococcus aureus
  subsp. aureus IS-160
MTYRMKKWQKLSTITLLMAGVITLNGGEFRSIDKHQIAVADTNVQTLDYEKLRNTWLDVNYGYNQYDEKNDAMKKKFDATENEAKKLLEDMKTENDRKYLWDSAKDLDTKSADMTRTYRNIEKIAEAMKHKNTKLKTDENKKKVKDALEWLHKNAYGKEPTEKVKELSENFKITDSSKKKALNWWDYEIGTPRALTNTLILLKEDFTDEEKKKYTAPIKTFAPDSEKILSSVGKPEQAKGGNLVDIAKVKLLESIIEEDTTMMKESIDAFNKVFTYVQSNATGKERNGFYKDGSYIDHQDVPYTGAYGVVLLEGISQMMPMIKATPFKDSNQNDTTLKSWIDEGFMPLIYKSEMMDLSRGRAISRENETSHSASATVMKSLLRLSDAMDDSTKAKYKKIVKTSVESDSSYKQTDYLNSYSDIDKMKSLMTDSTISTNGLTQQLKIYNDMDRVTYHNKDLDFAFGLSMTSKNVARYESINNENLKGWHTGAGMSYLYNSDVKHYRDNFWATADMKRLAGTTTLDNEEPKENKNSDKTFVGGTKFDDQHASIGMDFENQDKTLTAKKSYFILNDKIFFLGTGIKSTDSSKNPVTTIENRKANGYTLYTDDKQTTASDNQGTNSVFLESPNKPKNNIGYHFLNKPKITVKKESHTGKWSDINKSQKDTQKTDEYYEVTQKHSDKDDKYGYVLYPGISKNVFNTKKDLVTIVKQDDDFHVVKDNESVWAGVNYSNSTQTFDINNTKVEVKAKGMFILKKKDDNTYECSFYNPESTNTASDIVSKISMTGYSITNKNTSTTNESGVRFELTK

SEQ ID NO: 39201 - protein, 430 aa, Staphylococcus aureus
  subsp. aureus IS-160
MRDKKGPVNKRVDFLSNKLNKYSIRKFTVGTASILIGSLMYLGTQQEAEAAENNIENPTTLKDNVQSKEVKIEEVTNKDTAPQGIEAKSEVTSNKDTIEHEPSVKAEDISKKEDTPKEVANVAEVQPKSSVTHNAETPKVRKARSVDEGSFDITRDSKNVVESTPITIQGKEHFEGYGSVDIQSNPEDLKVSEVTRFNNKSIGRNELTGALQLKNKVSFKNDFEFNIRIANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKT

SEQ ID NO: 39202 - protein, 931 aa, Staphylococcus aureus
  subsp. aureus IS-160
MIVVGMGQENEAAASEQNNTTVEESGSSATERKASETQTTTNNVNTIDETQSYSATSTEQPSQSTQVTTEEAPTTVQAPKVETSRVDLPSEKVADKETTGTQVDTAQPSNASEIKPRMKRSTDVAAVAEKEVVGEAKTTGSDVTSKVTVENGSEIVGHNNKETNVVNPHNAERVTLKYKWKFGEDIKPGDYFDFTLSNNVETHGISTLRKVPEIKSTDGQVMAVGEVNEERKIRYTFKEYVQGKKDLKAELDLNLFIDPTTVTKRGNQNIEVTLGEKKISKQFDIKYLDGVKDNWGVTVNGRIHTLNKQEGRFSHFAYVKPNNQSLSSVTVSGQVTKGNKSGASNPTVKVYKHIGSDELAESVYGDILDETKFEDVTDKLSLTLTGNGGYTLDFSELDKTKNYVIKYEGDYDSSASDLNFQTKLSGYHNYYYSYYPVQLTWNNGVAFYSNKAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENNHHISHSGLGTENGHGNYGVIEEIEENTHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHNEIIEEDTNKDKPNYQFGGHNSVDFEEDTLPKVSGQNEGQQTIEEDTTSPTPPTPEVPSEPETPTPPTPEVPSEPETPTPPTPEVPSEPETPTPPTPEVPTEPGKPVSPTKEEPKKPSKPVEQGKVVTPVIEINEKVKVVAPTKQKQSKKSELPETGGEESTNKGMLFGGLFSILGLALLRRNKKNNKA

SEQ ID NO: 39203 - protein, 127 aa, Staphylococcus aureus
  subsp. aureus IS-160
TPTPPTPEVPSEPETPTPPTPEVPSEPGTPVPPTPEVPAEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 39204 - protein, 105 aa, Staphylococcus aureus
  subsp. aureus IS-160
DSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 39205 - protein, 231 aa, Staphylococcus aureus
  subsp. aureus IS-160
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSAGQANQVQSQEVEAPQNAQTQQPQASTSNNSQVTATPTESKASEGSSVIVNDHLKQIAQRESGGNIHAVNPTSGAAGKYQFLQSTWDSVAPAKYKGVSPANAPESVQDAAAVKLYNTGGAGHWVTA

SEQ ID NO: 39206 - protein, 2477 aa, Staphylococcus aureus
  subsp. aureus IS-160
MNLFRQQKFSIRKFNVGIFSALIATVTFISTNPTTASAAEQNQPAQNQPAQPADANTQPNANAGAQANPTAQPATPANQGQPAAQPASQGGQANPAGGAAQPNTQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPIVTVTDKVNGYSLINNGKIGFVNSELRRSDMFDKNNPQNYQARGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEFTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIGRINAAKVSGVKAIEATTTAQDLERVKNEEISKIENITDSTQTKMDAYNEVKQAATARKAQNATVSNATNEEVAEADAAVDAAQKQGLHDIQVVKSKQDVADTKSKVLDKINAIQTQAKVKPAADTEVENAYNTRKQEIQNSNASTTEEKQAAYTELDTKKQEARTNLDAANTNSDVTTAKDNGIAAINQVQAATTKKSDAKAEIAQKASERKTAIEAMNDSTTEEQQAAKDKVDQAVVTANTDIDNAAANTDVDNAKTTNEATIAAITPDANVKPTAKQAITDKVQAQETAIDANNGATTEEKAAAKQQVQTEKTTADAAIDGAHSNAEVEAAKNAEIAKIEAIQPATTTKDDAKQAITTKANERKTVIAQTQDITAEEIAAANANVDNAVTQANSNIEAANSQNDVDQAKTTGETSIDQVTPTVNKKATARNEITTILNNKLQAIQATPDATNEEKQAADAEANTENGKAIQAIAAATTNADVDEAKANAEAAINAVTPKVVKKQAAKDEIDQLQVAQTSVINNDQNATNEEKEAAIQQLATAVTDAKNNITAATDDNGVDQAKDAGKNSIQSTQPATAVKSNAKNDVDQAVTTQNQAIDNTTDATTEEKNAAKDLVLKAKEKAYQDILNAQTTNDVTQIKDKAVADVQGITADTTIKDVAKDELATKANEQKALIAQTADATTEEKEQANQQVDAQLTQGNQNIENAQSIDDVNTAKDNAIQAIDPIQASTDVKRNARAELLTEMQNKITEILNDNTTTNEEKGKDIEPVRAAYEEGLNNINTANTTGDVTTAKDTAVQKVQQLHANPVKKPAGKKELDQAAADRKTQIEQTPNASQQEINDAKQEVDTELNQAKTNVDQSSTNDYVDNAVKEGKARINAVKTFSEYKKDALAKIADAYNAKVNEADNSNASTSSEIAEAKQKLSELKQTADQNVNQATSKDDIEVQIHTDLDNINDYTIPTGKKETATTDLYAYADQKKNNISADTNATQDEKQQAIKQVDQNVQTALESINNGVDNGDVDDALTQGKAAIDAIQVDATVKPKANQAIEAKAEDTKESIDHSDQLTAEEKTEALAMIKQIKDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPNANDTNSGSDNNDATANSNANATPENTGQPNVTESTDNGKADASPTTPNNSDPATGETTATDDANNKPTANNNSSVDESADNSATGNGTTDKPEVESTNNGTTDKPATETDNATPAESTTNNNSTTATNENAPTGSTATAPTTNASTGAASSADSKDNASVNDSKQNAEVNNSAESQSTNGKVAQPKSENKAKAEKDGRDSTNQSMVESTAETLPSADITEPKVSSNTSKDKKESTTNQTGAGQLKSETNVASNEADKSEGNVDTEVSNKPSISKPSEAKDKATSTEDSQKADMSTADTKDNQASIGATADVNNKATQNDGANASPATVSKGSNSANQGMLKVTNTDKHQAKVTSAQQGKVNKPKQQAKTLPDTGMSHNDDLPYAELALGAGMAFLIRRFTKKDQQTEE

SEQ ID NO: 39207 - protein, 321 aa, Staphylococcus aureus
  subsp. aureus IS-160
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFHSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 39208 - protein, 315 aa, Staphylococcus aureus
  subsp. aureus IS-160
MLKNKILATTLSVSLLAPLANPLLENAKAANDTEDIGKGSDIEIIKRTEDKTSNKWGVTQNIQFDFVKDKKYNKDALILKMQGFISSRTTYYNYKNTNHIKSMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSDLPPLVQSGFNPSFIATVSHEKGSSDTSEFEITYGRNMDVTHAIKRSTHYGNSYLDGHRIHNAFVNRNYTVKYEVNWKTHEIKVKGQN

SEQ ID NO: 39209 - protein, 325 aa, Staphylococcus aureus; identical to SEQ ID NO: 30407
  subsp. aureus IS-160

SEQ ID NO: 39210 - protein, 528 aa, Staphylococcus aureus
  subsp. aureus IS-160
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKEESTTSSTQQQQNNVTATTETKPQNIEKENVKPSTDKTATEDTSVILEEKKAPNNTNNDVTTKPSTSETQTKPTTPQESTNIENSQPQPTPSEVDNQVTDATNPKEPVNVSKEELKNNLEKLKELVRNDSNTDRSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNSNQQLPQSNRIYDFSQYEDVTSQFDNKNHLVIM

SEQ ID NO: 39211 - protein, 155 aa, Staphylococcus aureus
  subsp. aureus IS-160
DSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSNAGKHTPAKPMSEVKDHHNKAKALPETGSENNNSNNGTLFGGLFAALGSLLLFGRRKKQNK

SEQ ID NO: 39212 - protein, 43 aa, Staphylococcus aureus
  subsp. aureus IS-160
RVRDDYQLHWTSTNWKGTNTKDKWTDRSSERYKIDWEKEEMTN

SEQ ID NO: 39213 - protein, 165 aa, Staphylococcus aureus
  subsp. aureus IS-160
MKNKLIAKSLLTIAAIGITTTTIASTADASEGYGPREKKPVSINHNIVEYNDGTFKYQSRPKFNSTPKYIKFKHDYNILEFNDGTFEYGARPQFNKPAAKTDVTIKKEQKLIQAQNLVREFEKTHTVSAHRKAQKAVNLVSFEYKVKKMVLQERIDNVLKQGLVK

SEQ ID NO: 39214 - protein, 109 aa, Staphylococcus aureus; identical to SEQ ID NO: 33345
  subsp. aureus IS-160

SEQ ID NO: 39215 - protein, 231 aa, Staphylococcus aureus
  subsp. aureus IS-160
MKMKNIAKISLLLGILATGVNTTTEKPVHAEKKPIVISENSKKLKSYYTQPSIEYKNVTGYISFIQPSIKFMNIIDGNSVNNIALIGKDKQHYYTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 39216 - protein, 356 aa, Staphylococcus aureus
  subsp. aureus IS-160
MKMRTIAKTSLALGLLTTGAITVTTQSVKAEKVQSTKVDKVPTLKAERLAMINITAGANTATTQAANTRQERTPKLEKAPNTNEEKTSASKIEKISQPKQEAQKSNNISTTPVPKQEQSQTTTEPTTPKTKVTTPQSINTPQPMQSTKSDTPQSPTIKQAQTDMTPKYEDLRSYYTKPSFEFEKQFGFMLKPWTTVRFMNVIPNRFIYKIALVGKDEKKYKDGPYENIDVFIVLEDNKYQLKKYSVGGITKTNSKKVDHKAELSITQENNQGTISRDVSEYMITKEEISLKELDFKLRKQLIEKHNLYGNMGSGTIVIKMKNGGKYTFELHKKLQEHRMADVIEGTNIDKIEVNIK

SEQ ID NO: 39217 - protein, 208 aa, Staphylococcus aureus
  subsp. aureus IS-160
METPQSPTTKQVPTEINPKFKDLRAYYTKPSLEFKNEIGIILKKWTTIRFMNIVPDYFIYKIALVGKDDKKYGEGVHRNVDVFVVLEENNYNLEKYSVGGITKSNSKKVDHKAGVRITKEDKKGTISHDVSEFKITKEQISLKELDFKLRKQLVENHNLYGNVGSGKIIIKMKNGGKYTFELHKKLQKDRMADVIDGTNIDSIEVNIK

SEQ ID NO: 39218 - protein, 234 aa, Staphylococcus aureus
  subsp. aureus IS-160
MKMTAIAKASLALGILATGTITSTHQTVNASEHEAKYENVTKDIFDLRDYYSGASKELKNVTGYRYNKGGKHYLIFDKNRKFTRVQIFGKDIERFKARKNPGLDIFVVKEAENRNGTVFSYGGVTKKNQDAYYDYINVPRFQIKRDEGDGIATYGRVHYIYKEEISLKELDFKLRQYLIQNFDLYKKFPKDSKIKVIMKDGGYYTFELNKKLQTNRMSDVIDGRNIEKIEASIR

SEQ ID NO: 39219 - protein, 231 aa, Staphylococcus aureus
  subsp. aureus IS-160
MKLKTLAKATLALGLLTTGVITSEGQAVHAKEKQERVQHLYDIKDLHRYYSSESFEFSNISGKVENYNGSNVVRFNQDGQNHQLFLLGEDKEQYKQGLQGQNVFVVKELIDPNGRLSTVGGVTKKTNQSSETNTPLVVNKVYGGDLHASIDSFSINKEEVSLKELDFKIRKQLVEKYGLYQGTTKYGKITFNLKDGEKKEIDLGDKLQFERMGDVLNSKDINKIEVTLKQI

SEQ ID NO: 39220 - protein, 232 aa, Staphylococcus aureus
  subsp. aureus IS-160
MKFTAIAKAIFVLGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKGGFSIDEFFFIQKEEVSLKELDFKIRKLLIKKYKLYEGSADKGRIVINMKDENKYEIDLSDKLDFERMADVISSEQIKNIEVNLK

SEQ ID NO: 39221 - protein, 232 aa, Staphylococcus aureus
  subsp. aureus IS-160
MKFTALAKATLALGILTTGVFTAESKAVHAKVELDETQRKYYINMLHQYYSEESFEPTNISVKSEDYYGSNVLNFNQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTADKGRIVINMKDEKKHEIDLSEKLSFERMFDVMDSKKIKNIEVNLN

SEQ ID NO: 39222 - protein, 227 aa, Staphylococcus aureus
  subsp. aureus IS-160
MKFTALAKATLALGILTTGTLTTEAHSSHAKQNQESVNKHDKEALYRYYTGKTMELKNINALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKEKITLKELDFKLRKHLIEKYGLYKTISKDGRVKISLKDGSFYNLDLRSKLKFKYMGEVIESKQIKDIEVNLK

SEQ ID NO: 39223 - protein, 233 aa, Staphylococcus aureus
  subsp. aureus IS-160
MKLKNIAKASLALGILTTGMITTTAQPVKASEYSDLRAVSNDTFNLKTYYTGPNFNYKNLKGYKEGNKVEFVDEITHQLNVIDLKGSDKEKLKDMIDGTLFDVFVVREGTTKDATNYSIGGISNPNSESYIDTLKNVNLKVSKKVSSNSATVASSHFEINKEEISLKELDFKLRKQLIDNHDLYKTEPKDSKITVTMNNGDYYTFELNKKLQEHRMGDVIDGTKIKEINVELN

SEQ ID NO: 39224 - protein, 776 aa, Staphylococcus aureus
  subsp. aureus IS-160
MNNKKTATNRKGMIPNRLNKFSIRKYSVGTASILVGTTLIFGLSGHEAKAAERTNGELNQSKNETTAPSENKTTEKVDSHQQNNIEQSTTSNQPKVNESDNTSVKETTEEPQNTTSTQPTKQNNDATANKDNLAAQNISTQAKDVSATPKTTTIKPRTLNRMAVNTVAAPQQGTNVNDKVHFSNIDIAIDKGHVNKDTGKTEFWATSSDVLKLKANYTIDDSVKEGDTFTFKYGQYFRPGSVRLPSQTQNLYNAQGNIIAKGIYDSNTNTTTYTFTNYVDQYTNVSGSIEQVAFAKRENATTDKTAYKMEVTLGNDKYSKDVIVDYGNKKAQPLISSTNYINNEDLSRNMTAYVNQPKNTYTKQTFVTNLTGYKFNPNAKNFKIYEVTNQNQFVDSFTPDTSKLTDVTNQFNITYSNDNKTASVDLMNGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSD

SEQ ID NO: 39225 - protein, 1729 aa, Staphylococcus aureus
  subsp. aureus IS-160
MNYRDKIQKFSIRKYTVGTFSTVIATLVFLGFNTSQAHAAETNQPASVVKQKQQSNNEQTENRESQVQNSQNSQNGQSLSATHENEQPKISQANLVDQKVAQSSTTNDEQPASQNVNTKKDSATAATTQPDKEENKHKQNESQSANKNGNDNRAAHVENHEANVVTASDLSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPHRSHDFKIRNRSGQVIYEWPTVHIYSLEDLSRASDYFSEAGATAATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYSTNANTNAFRPGGAQELNEYQLSQLFTDQKLQEAARTRNPIRLMIGFDYPDGYGNSETLVPVNLTVLPEIQHNIKFYKNDDTQNIAEKPFSKQAGHPVFYVYAGNQGNASVNLGGSVTSIQPLRINLTSNENFTDKDWQITGIPRTLHIENSTNRPNNARERNIELVGNLLPGDYFGTIRFGRKEQLFEIRVKPHTPTITTTAEQLRGTELQKVPVNISGIPLDPSALVYLVAPTAQTTNGGTEADQIPSGYTILATGTPDGVHNTITIRPQDYVVFIPPVGKQIRAVVYYNKVVASNMSNAVTILPDDIPPTINNPVGINAKYYRGDEVNFTMGVSDRHSGIKSTTITTLPSGWTSNLTKSDNKNGSLAITGRVSMNQAFNSDITFKVSATDNVNNTTNDSQSKHVSIHVGKISEDAHPIVLGNTEKVVVVNPTAVSNDEKQSIITAFMNKNQNIRGYLASSNPVTVDNNGNVTLHYRDGSSTTLDATNVMTYEPVVKPEYQTANAAKTATVTIAKGQSFNIGDIKQYFTLSNGQAIPSGTFTNITSDRAIPTAQEVSQMNAGTQLYHIVASNAYHKDTEDFYISLKIVDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKAQAEAGGRPNYRTTGYSQANASSDGQRQYTLNGQVIQILDIINPSNGYGGQTVTNSNTRANHSNSTVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPTTSQITGTVDNNHQHVSATAPNVTSATTKTINLLATDTSGNTATTTFNVTVKPLRDKYRVGTSSTAANPVRIANISNNATVSQADQTAIINSLTFTETVPNRNYATASANEITSKTVSNVSRTGNNANVTVTVTYQDGTTSTVTVPVKHVIPEIVAHSHYTVQGQDFPAGNGSSASDYFKLSNGSAIPDATITWVSGQAPNKD

SEQ ID NO: 39226 - protein, 221 aa, Staphylococcus aureus
  subsp. aureus IS-160
MKAKLWFLLTTLAFLIAVTGSIGIAEVKAKTTGLITENSNDSLKEHYAQKFEVYTNKEVTGVGENYIDTKVDTYNVRTVLYNTDYLKQFKNQDKVNIWGTLYENQQSKVYRGTVVKYDPISKVTNLSYRMNLFVNGHQTKVNPDSLLEVKNKQISLKETDFRIRKYLLEKEHLYSNYNSGELIIEMKNGARHKIDLGDILSDSQEKTFDFDNISHIDIYMK

SEQ ID NO: 39227 - protein, 233 aa, Staphylococcus aureus; identical to SEQ ID NO: 30678
  subsp. aureus IS-160

SEQ ID NO: 39228 - protein, 331 aa, Staphylococcus aureus
  subsp. aureus IS-160
MSNQFKSEEERRQWEQFQAFQNQQNQQHQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKYKKLEVISSLFSVKKITFDLSDAKKTSKAKKDKQDTEVAVASSNSDNVSYEASATTPATTSSEDSDSEDSEKSNKDEDKQNASKSDKSSVEKSESNEETTPVEPMRQSKPTTSEAPPSQNIHNEDSMYDASTE

SEQ ID NO: 39229 - protein, 361 aa, Staphylococcus aureus
  subsp. aureus IS-160
MDRVTYHNKDLDFAFGLSMTSKNVARYESINNENLKGWHTGAGMSYLYNSNVKHYRDNFWATADMKRLAGTTTLENEEPKGTDVKMSSKTFVGGTKFDDQHASIGMDFENQDKTLTAKKSYFILNDKIIFLGTGIKSTDSSKIPVTTIENRKANGYTLYTDDKQITASDNQETNSVFLESTNSTQNNIGFQFLNKSKITVKKESHTGKWSDINKSQKSEDKKDEYYEVNQKHSNTDDKYGYVLYPGLSKDDFKTKKDEVTVVKQGDDFHVVKDNESVWAGVNYSDSTKTFEINGTKVEVKAKGMFILKKKDDKTYECSFFNPESTNSVSDIESKIFIKGYTITNKSVTNSNDAGLNFELTK

SEQ ID NO: 39230 - protein, 949 aa, Staphylococcus aureus
  subsp. aureus IS-160
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNDKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDNTGKNLKTQVIQENIDPATGKDYSIFGWNNENVVRYGGGSADGDSAVNPKDPTPGPPVDPEPEPEPTPDPEPSPDPEPEPTPDPEPSPDPDPEPTPDPEPSPEPDPEPTPDPEPSPEPDPDSDSDSDSGSDSDSGSDSDSDSDSDSDSDSDSDSDSDSDSDSDSDSDSDSDSDSDSDSDSDSDLDSDSDSDSDSDSDSDSDSDSDSDSDSDSDLDSDSDSDSDSDSDSDSDLDSDSDSDSDSDSDSDSDSDSDSDSDSDSDSDSDSDSDSDSDSDSDSDSDSDSDSDSDSDSDSESDSDSDSDSDSDSDSDSDSDSDSESDSDSDSDSDSDSDSDSESDSDSDSDSDSDSDSDSDSDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 39231 - protein, 2266 aa, Staphylococcus aureus
  subsp. aureus IS-160
MSKRQKEFHDSLANEKTRVRLYKSGKNWVKSGIKEIEMFKIMGLPFISHSIVSQDNQSISKKMTGYGLKTTAVIGGAFTVNMLHDQQAFAASDAPLTSELNTQSETVGNQNSTTIDASTSTADSTSVTKNSSSVQTSNSDTVSSEKSENVTSTTNSTSNQQEKLTSTSESTSSKNTTSSSDTKSVASTSSTEQPINTSTNQSTASNNTSQSTTPSSANLNKTSTTSTSTAPVKLRTFSRLAMSTFASAATTTALTANTITVNKDNLKQYMTTSGNATYDQSTGIVTLTQDTYSQKGAITLGTRIDSNKSFHFSGKVNLGNKYEGHGNGGDGIGFAFSPGVLGETGLNGAAVGIGGLSNAFGFKLDTYHNTSTPNSAAKAKADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPAVTPIGDKSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIMTSTSVSTSKSTSTSLSDSVSASKSLSTSESNSESSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESGSTSESISISNSISNSVSASTSKSDSQSTSISLSTSDSKSMSTSESLSDSTSTSDSVSGSLSVAGSQSVSTSTSDSMSTSEMISDSMSTSGSLAASDSKSMSVSSSMSTSQSGSTSESLSDSISTSDSDSKSLSLSTSQSGSTSTSTSTSSSVRMSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSVSTSESTSESVSSSTSASTSLSDSTSESGSTSTSLSNSTSGSASISTSTSNSESTSTFKSESVSTSLSTSTSTSLSDSTSLSTSLSDSTSDSKSDSLSTSMSTSDSISTRKSESLSASTSLSGSTSESESGSTSSSESTSESTSMSLSVSQSTSGSTSLSTSESLSDSTSTSLSLSASMNQSGVDSNSASQSASTSTSTSTSESDSQSTSSYTSQSGSTSESTSTSTSLSDSTSISKSTSQSGSTSTSASLSGSESESDSQSISTSTSESKSESTSTSLSDSTSTSNSGSASTSTSLSNSASISESDSSSTSLSDSKSASMQSSESDSQSTSTSLSNSQSTSTSNRMSTIASESVSESTSESGSTSESTSESDSTSTSLSNSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESSSLSDSMSMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSISVSDSSSTSTSESLSDSMAQSQSTSTSASGSLSTSISSSMSASASTSKSQSTSVSTSLSTSDSISDSTSISISGSQSAVESESTSDSTSISDSESLSTSGSTSGSTSTSTSESLSTSGSGSTSVSESLSTSGSGSTSVSDSSSTSSSLSTSGSTSVSDSTSMSDSESVSTSASTSLSTSNSESASVSISDSTSSSMSNSMSMSTSESNSIHPSNSMSTSQTHFTSTSISTSESIAPNTNESQSTLSATSVSSKHDAEPAQREERLPDTGDSIKQNGLLGGVMTLLVGLGLMKRKKKKDENDQDDSQA

SEQ ID NO: 39232 - protein, 681 aa, Staphylococcus aureus
  subsp. aureus IS-160
MMKSQNKYSIRKFSVGTSSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRTKEAPPLNKSDQTSQRKIVNKTEIEKVQPQQNNQANAKITKHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDEINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 39233 - protein, 102 aa, Staphylococcus aureus
  subsp. aureus IS-160
PKDPKGPEKPEKPSRPTHPSGPVNPDNPGLSKDRAKPNDPVHSMDKNDKVKKSKIAKESVANQEKKRAELPKTGVESTQKGLIFSSIIGIAGLILLARRRKN

SEQ ID NO: 39234 - protein, 165 aa, Staphylococcus aureus
  subsp. aureus IS-160
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDADSDSDAGKHTPVKPMSATKDHHNKAKALPETGSENNGSNNATLFGGLFAALGSLLLFGRRKKQNK

SEQ ID NO: 39235 - protein, 727 aa, Staphylococcus aureus
  subsp. aureus IS-160
MLNRENKTAMTRKGMVSNRLNKFSIRKYTVGTASILVGTTLIFGLGNQEAKAAEVTNKEMKEDATSVNNDQVSKKVDTEQLNNGGNTSKVDTEQLKDENINKVANQKEVTRVENSVASEKNNNSKPSENGKLQTSDVKKTEDNNATSDDQVTTTVNSQQLNTDNTTSNETMSSAPINVSKDNLKINSEVVKNVVENSDNTDNANGSDVIMPKSTAPKRLNTRMRIAAVQPSSTDSKNVNNLITSTTTLTVVDADNSKTIVPAQDYLSLKSQITVDDKVKSGDYFTIKYSDTVQVYGLNPEDIKNIGDIKDPNNGETIATAKHDTVNNLITYTFTDYVDRFNSVKMGINYSVYMDADTIPVDKKDVPFSVTIGNQTTTTTADITYPAYKEADNNSIGSAFTETVSHAGNAEDPGYYNQVVYVNPMDKDLKGANLKVEAYHPKYPTNIGQINQNVTNIKIYRVPEGYTLNKGYDVNANDLVDVTDEFKNKMTYGSNQSVNVDFGDITSAYVVMVNTKFQYTNSESPTLVQMATLSSTGNKSVSTGNALGFTNNQSAGAGQEVYKIGNYVWEDTNKNGIQELGEVGVKGVTVVAYDNKTNKEVGRTITDEKGGYLIPNLPNGDYRVEFSNLPQGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDL

SEQ ID NO: 39236 - protein, 157 aa, Staphylococcus aureus
  subsp. aureus IS-189
MPIWRCNIKKGAIKMNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKR

SEQ ID NO: 39237 - protein, 242 aa, Staphylococcus aureus; identical to SEQ ID NO: 30396
  subsp. aureus IS-189

SEQ ID NO: 39238 - protein, 760 aa, Staphylococcus aureus
  subsp. aureus IS-189
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYINPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKKIKIRNK

SEQ ID NO: 39239 - protein, 434 aa, Staphylococcus aureus [sequence omitted]

SEQ ID NO: 39240 - protein, 96 aa, Staphylococcus aureus; identical to SEQ ID NO: 30813
  subsp. aureus IS-189

SEQ ID NO: 39241 - protein, 112 aa, Staphylococcus aureus; identical to SEQ ID NO: 38896
  subsp. aureus IS-189

SEQ ID NO: 39242 - protein, 209 aa, Staphylococcus aureus; identical to SEQ ID NO: 35260
  subsp. aureus IS-189

SEQ ID NO: 39243 - protein, 196 aa, Staphylococcus aureus
  subsp. aureus IS-189
MLKNKILTTTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKKCFMGRQSEFIRH

SEQ ID NO: 39244 - protein, 325 aa, Staphylococcus aureus; identical to SEQ ID NO: 30407
  subsp. aureus IS-189

SEQ ID NO: 39245 - protein, 688 aa, Staphylococcus aureus
  subsp. aureus IS-189
MKWSNIFEKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDS

SEQ ID NO: 39246 - protein, 260 aa, Staphylococcus aureus
  subsp. aureus IS-189
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKTIKNHQLNQQRTMTRKMD

SEQ ID NO: 39247 - protein, 328 aa, Staphylococcus aureus
  subsp. aureus IS-189
MTWSNLPENDKNGKTIKYLVKEVNAQGKDTTPEGYTKKEDGLVVTNTEKPIETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 39248 - protein, 225 aa, Staphylococcus aureus; identical to SEQ ID NO: 30763
  subsp. aureus IS-189

SEQ ID NO: 39249 - protein, 257 aa, Staphylococcus aureus; identical to SEQ ID NO: 30259
  subsp. aureus IS-189

SEQ ID NO: 39250 - protein, 319 aa, Staphylococcus aureus
  subsp. aureus IS-189
MKTHIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNSVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 39251 - protein, 165 aa, Staphylococcus aureus; identical to SEQ ID NO: 30742
  subsp. aureus IS-189

SEQ ID NO: 39252 - protein, 109 aa, Staphylococcus aureus; identical to SEQ ID NO: 30744
  subsp. aureus IS-189

SEQ ID NO: 39253 - protein, 350 aa, Staphylococcus aureus
  subsp. aureus IS-189
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTITSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 39254 - protein, 645 aa, Staphylococcus aureus; identical to SEQ ID NO: 30747
  subsp. aureus IS-189

SEQ ID NO: 39255 - protein, 291 aa, Staphylococcus aureus; identical to SEQ ID NO: 31911
  subsp. aureus IS-189

SEQ ID NO: 39256 - protein, 117 aa, Staphylococcus aureus
  subsp. aureus IS-189
ESDSDSESDSDSDSDSDSDSDSDSDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 39257 - protein, 196 aa, Staphylococcus aureus; identical to SEQ ID NO: 30587
  subsp. aureus IS-189

SEQ ID NO: 39258 - protein, 125 aa, Staphylococcus aureus; identical to SEQ ID NO: 33215
  subsp. aureus IS-189

SEQ ID NO: 39259 - protein, 981 aa, Staphylococcus aureus
  subsp. aureus IS-189
MIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 39260 - protein, 233 aa, Staphylococcus aureus; identical to SEQ ID NO: 31039
  subsp. aureus IS-189

SEQ ID NO: 39261 - protein, 331 aa, Staphylococcus aureus; identical to SEQ ID NO: 30732
  subsp. aureus IS-189

SEQ ID NO: 39262 - protein, 435 aa, Staphylococcus aureus
  subsp. aureus IS-189
MLRGQEERKYSIRKYSIGVVSVLAATMFVVTSHEAQASEKIPTTNAAAQKETLNQPGEQGNAITSHQMQSGKQLDDMHKENGKSGTVTEGKDMLQSSKHQSTQNSKIIRTQNDNQVKQDSERQGSKQSHQNNATNKTERQNDQIQNTHHAERNGSQSTTSQSNDVDKSQPSIPAQKVIPNHDKAAPTSTTPPSNDKTAPKSTKEQDATTDKHPNQQDTHQPAHQIIDAKQDDNVHQSNQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKYKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIA

SEQ ID NO: 39263 - protein, 895 aa, Staphylococcus aureus; identical to SEQ ID NO: 33759
  subsp. aureus IS-189

SEQ ID NO: 39264 - protein, 2186 aa, Staphylococcus aureus; identical to SEQ ID NO: 31059
  subsp. aureus IS-189

SEQ ID NO: 39265 - protein, 250 aa, Staphylococcus aureus
  subsp. aureus IS-189
EEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39266 - protein, 190 aa, Staphylococcus aureus; identical to SEQ ID NO: 30534
  subsp. aureus IS-189

SEQ ID NO: 39267 - protein, 327 aa, Staphylococcus aureus; identical to SEQ ID NO: 30538
  subsp. aureus IS-189

SEQ ID NO: 39268 - protein, 311 aa, Staphylococcus aureus; identical to SEQ ID NO: 31928
  subsp. aureus IS-189

SEQ ID NO: 39269 - protein, 221 aa, Staphylococcus aureus; identical to SEQ ID NO: 31036
  subsp. aureus IS-189

SEQ ID NO: 39270 - protein, 167 aa, Staphylococcus aureus
  subsp. aureus IS-189
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSANLLAEAKKLNESQAPKADNKFNKEQQNAFL

SEQ ID NO: 39271 - protein, 274 aa, Staphylococcus aureus; identical to SEQ ID NO: 30872
  subsp. aureus IS-189

SEQ ID NO: 39272 - protein, 338 aa, Staphylococcus aureus; identical to SEQ ID NO: 30699
  subsp. aureus IS-189

SEQ ID NO: 39273 - protein, 351 aa, Staphylococcus aureus; identical to SEQ ID NO: 30720
  subsp. aureus IS-189

SEQ ID NO: 39274 - protein, 872 aa, Staphylococcus aureus
  subsp. aureus IS-189
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDQTATQTQIATQTQIATQTQIATQTRIAIQIQTAIRTQTTTQIQIAIQIQMQVNILRLNQ

SEQ ID NO: 39275 - protein, 1201 aa, Staphylococcus aureus
  subsp. aureus IS-189
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTLQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYKFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSD

SEQ ID NO: 39276 - protein, 133 aa, Staphylococcus aureus
  subsp. aureus IS-189
DSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 39277 - protein, 149 aa, Staphylococcus aureus
  subsp. aureus IS-189
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 39278 - protein, 204 aa, Staphylococcus aureus; identical to SEQ ID NO: 31936
  subsp. aureus IS-189

SEQ ID NO: 39279 - protein, 203 aa, Staphylococcus aureus; identical to SEQ ID NO: 30770
  subsp. aureus IS-189

SEQ ID NO: 39280 - protein, 657 aa, Staphylococcus aureus; identical to SEQ ID NO: 38419
  subsp. aureus IS-189

SEQ ID NO: 39281 - protein, 119 aa, Staphylococcus aureus; identical to SEQ ID NO: 38421
  subsp. aureus IS-189

SEQ ID NO: 39282 - protein, 141 aa, Staphylococcus aureus; identical to SEQ ID NO: 30715
  subsp. aureus IS-189

SEQ ID NO: 39283 - protein, 226 aa, Staphylococcus aureus; identical to SEQ ID NO: 30769
  subsp. aureus IS-189

SEQ ID NO: 39284 - protein, 231 aa, Staphylococcus aureus; identical to SEQ ID NO: 30768
  subsp. aureus IS-189

SEQ ID NO: 39285 - protein, 352 aa, Staphylococcus aureus; identical to SEQ ID NO: 30767
  subsp. aureus IS-189

SEQ ID NO: 39286 - protein, 308 aa, Staphylococcus aureus; identical to SEQ ID NO: 31787
  subsp. aureus IS-189

SEQ ID NO: 39287 - protein, 234 aa, Staphylococcus aureus; identical to SEQ ID NO: 31052
  subsp. aureus IS-189

SEQ ID NO: 39288 - protein, 171 aa, Staphylococcus aureus
  subsp. aureus IS-189
MKLKTLAKATLVLGLLATGVITTESQTVKAAESTQGQHNYKSLKYYYSKPSIELKNLDGLYRQKVTDKGVYVWKDRKDYFVGLLGKDIEKYPQGEHDKQDAFLVIEEETVNGRQYSIGGLSKTNSKEFSKEVDVKVTRKIDESSEKSKDSKFKITKEEISLKELDFKLRKN

SEQ ID NO: 39289 - protein, 59 aa, Staphylococcus aureus
  subsp. aureus IS-189
MEEEKLYGAVNNRKGKIVVKMEDDKFYTFELTKKLQPHRMGDTIDGTKIKEINVELEYK

SEQ ID NO: 39290 - protein, 231 aa, Staphylococcus aureus; identical to SEQ ID NO: 30560
  subsp. aureus IS-189

SEQ ID NO: 39291 - protein, 68 aa, Staphylococcus aureus; identical to SEQ ID NO: 38389
  subsp. aureus IS-189

SEQ ID NO: 39292 - protein, 232 aa, Staphylococcus aureus; identical to SEQ ID NO: 30765
  subsp. aureus IS-189

SEQ ID NO: 39293 - protein, 157 aa, Staphylococcus aureus; identical to SEQ ID NO: 38930
  subsp. aureus IS-189

SEQ ID NO: 39294 - protein, 61 aa, Staphylococcus aureus; identical to SEQ ID NO: 33840
  subsp. aureus IS-189

SEQ ID NO: 39295 - protein, 983 aa, Staphylococcus aureus
  subsp. aureus IS-189
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSD

SEQ ID NO: 39296 - protein, 134 aa, Staphylococcus aureus
  subsp. aureus IS-189
ALSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 39297 - protein, 370 aa, Staphylococcus aureus
  subsp. aureus IS-189
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNELTKEIKIANLEAQNSNQKKTNKVTNNYFGYYSFREAPKTQIYTVKKGDTLSAIALKYKTTVSNIQNTNNIANPNLIFIGQKLKVPMTPLVEPKPVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 39298 - protein, 241 aa, Staphylococcus aureus; identical to SEQ ID NO: 30738
  subsp. aureus IS-189

SEQ ID NO: 39299 - protein, 241 aa, Staphylococcus aureus; identical to SEQ ID NO: 31953
  subsp. aureus IS-189

SEQ ID NO: 39300 - protein, 238 aa, Staphylococcus aureus; identical to SEQ ID NO: 30740
  subsp. aureus IS-189

SEQ ID NO: 39301 - protein, 250 aa, Staphylococcus aureus; identical to SEQ ID NO: 31910
  subsp. aureus IS-189

SEQ ID NO: 39302 - protein, 231 aa, Staphylococcus aureus; identical to SEQ ID NO: 31073
  subsp. aureus IS-189

SEQ ID NO: 39303 - protein, 2478 aa, Staphylococcus aureus; identical to SEQ ID NO: 31939
  subsp. aureus IS-189

SEQ ID NO: 39304 - protein, 225 aa, Staphylococcus aureus; identical to SEQ ID NO: 30763
  subsp. aureus IS-24

SEQ ID NO: 39305 - protein, 327 aa, Staphylococcus aureus; identical to SEQ ID NO: 30538
  subsp. aureus IS-24

SEQ ID NO: 39306 - protein, 311 aa, Staphylococcus aureus; identical to SEQ ID NO: 30617
  subsp. aureus IS-24

SEQ ID NO: 39307 - protein, 321 aa, Staphylococcus aureus; identical to SEQ ID NO: 30959
  subsp. aureus IS-24

SEQ ID NO: 39308 - protein, 112 aa, Staphylococcus aureus
  subsp. aureus IS-24
MLKNKILTTTLSVSLLAPLANPLLENAKAANDTEDIGKGSDIEIIKRTEDKTSNKWGVTQNIQFDFVKDKKYNKDALILKMQGFISSRTTYYNYKKLIMLKLCDGHSNIILV

SEQ ID NO: 39309 - protein, 213 aa, Staphylococcus aureus
  subsp. aureus IS-24
MRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 39310 - protein, 325 aa, Staphylococcus aureus; identical to SEQ ID NO: 30407
  subsp. aureus IS-24

SEQ ID NO: 39311 - protein, 196 aa, Staphylococcus aureus; identical to SEQ ID NO: 30587
  subsp. aureus IS-24

SEQ ID NO: 39312 - protein, 444 aa, Staphylococcus aureus; identical to SEQ ID NO: 32034
  subsp. aureus IS-24

SEQ ID NO: 39313 - protein, 917 aa, Staphylococcus aureus; identical to SEQ ID NO: 31037
  subsp. aureus IS-24

SEQ ID NO: 39314 - protein, 995 aa, Staphylococcus aureus; identical to SEQ ID NO: 31038
  subsp. aureus IS-24

SEQ ID NO: 39315 - protein, 1035 aa, Staphylococcus aureus
  subsp. aureus IS-24
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 39316 - protein, 156 aa, Staphylococcus aureus
  subsp. aureus IS-24
DSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKNKINNTAYTRSVRPGFLFQNL

SEQ ID NO: 39317 - protein, 434 aa, Staphylococcus aureus [sequence omitted]

SEQ ID NO: 39318 - protein, 127 aa, Staphylococcus aureus
  subsp. aureus IS-24
DSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 39319 - protein, 231 aa, Staphylococcus aureus; identical to SEQ ID NO: 31073
  subsp. aureus IS-24

SEQ ID NO: 39320 - protein, 648 aa, Staphylococcus aureus
  subsp. aureus IS-24
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDS

SEQ ID NO: 39321 - protein, 2271 aa, Staphylococcus aureus; identical to SEQ ID NO: 32024
  subsp. aureus IS-24

SEQ ID NO: 39322 - protein, 681 aa, Staphylococcus aureus; identical to SEQ ID NO: 32025
  subsp. aureus IS-24

SEQ ID NO: 39323 - protein, 274 aa, Staphylococcus aureus; identical to SEQ ID NO: 30872
  subsp. aureus IS-24

SEQ ID NO: 39324 - protein, 338 aa, Staphylococcus aureus; identical to SEQ ID NO: 30699
  subsp. aureus IS-24

SEQ ID NO: 39325 - protein, 321 aa, Staphylococcus aureus; identical to SEQ ID NO: 39082
  subsp. aureus IS-24

SEQ ID NO: 39326 - protein, 684 aa, Staphylococcus aureus; identical to SEQ ID NO: 33787
  subsp. aureus IS-24

SEQ ID NO: 39327 - protein, 331 aa, Staphylococcus aureus; identical to SEQ ID NO: 30732
  subsp. aureus IS-24

SEQ ID NO: 39328 - protein, 325 aa, Staphylococcus aureus; identical to SEQ ID NO: 30484
  subsp. aureus IS-24

SEQ ID NO: 39329 - protein, 312 aa, Staphylococcus aureus; identical to SEQ ID NO: 30196
  subsp. aureus IS-24

SEQ ID NO: 39330 - protein, 250 aa, Staphylococcus aureus; identical to SEQ ID NO: 31910
  subsp. aureus IS-24

SEQ ID NO: 39331 - protein, 291 aa, Staphylococcus aureus; identical to SEQ ID NO: 30390
  subsp. aureus IS-24

SEQ ID NO: 39332 - protein, 2186 aa, Staphylococcus aureus; identical to SEQ ID NO: 31059
  subsp. aureus IS-24

SEQ ID NO: 39333 - protein, 1225 aa, Staphylococcus aureus
  subsp. aureus IS-24
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSGLR

SEQ ID NO: 39334 - protein, 861 aa, Staphylococcus aureus
  subsp. aureus IS-24
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDIFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKNKINNMINLTRSMWPGFFCLEIPRYKTKIFKE

SEQ ID NO: 39335 - protein, 61 aa, Staphylococcus aureus; identical to SEQ ID NO: 34190
  subsp. aureus IS-24

SEQ ID NO: 39336 - protein, 458 aa, Staphylococcus aureus
  subsp. aureus IS-24
MLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKKVILVSGKK

SEQ ID NO: 39337 - protein, 119 aa, Staphylococcus aureus; identical to SEQ ID NO: 38421
  subsp. aureus IS-24

SEQ ID NO: 39338 - protein, 141 aa, Staphylococcus aureus; identical to SEQ ID NO: 30715
  subsp. aureus IS-24

SEQ ID NO: 39339 - protein, 233 aa, Staphylococcus aureus; identical to SEQ ID NO: 30428
  subsp. aureus IS-24

SEQ ID NO: 39340 - protein, 203 aa, Staphylococcus aureus; identical to SEQ ID NO: 30770
  subsp. aureus IS-24

SEQ ID NO: 39341 - protein, 690 aa, Staphylococcus aureus; identical to SEQ ID NO: 31973
  subsp. aureus IS-24

SEQ ID NO: 39342 - protein, 227 aa, Staphylococcus aureus; identical to SEQ ID NO: 30585
  subsp. aureus IS-24

SEQ ID NO: 39343 - protein, 232 aa, Staphylococcus aureus; identical to SEQ ID NO: 30765
  subsp. aureus IS-24

SEQ ID NO: 39344 - protein, 232 aa, Staphylococcus aureus; identical to SEQ ID NO: 31054
  subsp. aureus IS-24

SEQ ID NO: 39345 - protein, 231 aa, Staphylococcus aureus; identical to SEQ ID NO: 30560
  subsp. aureus IS-24

SEQ ID NO: 39346 - protein, 231 aa, Staphylococcus aureus; identical to SEQ ID NO: 31761
  subsp. aureus IS-24

SEQ ID NO: 39347 - protein, 234 aa, Staphylococcus aureus; identical to SEQ ID NO: 31052
  subsp. aureus IS-24

SEQ ID NO: 39348 - protein, 308 aa, Staphylococcus aureus; identical to SEQ ID NO: 31787
  subsp. aureus IS-24

SEQ ID NO: 39349 - protein, 352 aa, Staphylococcus aureus; identical to SEQ ID NO: 30767
  subsp. aureus IS-24

SEQ ID NO: 39350 - protein, 174 aa, Staphylococcus aureus; identical to SEQ ID NO: 38386
  subsp. aureus IS-24

SEQ ID NO: 39351 - protein, 226 aa, Staphylococcus aureus; identical to SEQ ID NO: 30769
  subsp. aureus IS-24

SEQ ID NO: 39352 - protein, 163 aa, Staphylococcus aureus; identical to SEQ ID NO: 38916
  subsp. aureus IS-24

SEQ ID NO: 39353 - protein, 1102 aa, Staphylococcus aureus; identical to SEQ ID NO: 32042
  subsp. aureus IS-24

SEQ ID NO: 39354 - protein, 372 aa, Staphylococcus aureus; identical to SEQ ID NO: 31084
  subsp. aureus IS-24

SEQ ID NO: 39355 - protein, 241 aa, Staphylococcus aureus; identical to SEQ ID NO: 30738
  subsp. aureus IS-24

SEQ ID NO: 39356 - protein, 241 aa, Staphylococcus aureus; identical to SEQ ID NO: 30739
  subsp. aureus IS-24

SEQ ID NO: 39357 - protein, 238 aa, Staphylococcus aureus; identical to SEQ ID NO: 30740
  subsp. aureus IS-24

SEQ ID NO: 39358 - protein, 319 aa, Staphylococcus aureus; identical to SEQ ID NO: 30741
  subsp. aureus IS-24

SEQ ID NO: 39359 - protein, 165 aa, Staphylococcus aureus; identical to SEQ ID NO: 30742
  subsp. aureus IS-24

SEQ ID NO: 39360 - protein, 75 aa, Staphylococcus aureus
  subsp. aureus IS-24
MKKNFIGKSILSIAAISLTVSTFAGESHAQTKNVEAAKKYDQYQTNFKKQVNKKVVDAQKSCKLFQTYKNCCNTP

SEQ ID NO: 39361 - protein, 350 aa, Staphylococcus aureus; identical to SEQ ID NO: 30602
  subsp. aureus IS-24

SEQ ID NO: 39362 - protein, 645 aa, Staphylococcus aureus; identical to SEQ ID NO: 30747
  subsp. aureus IS-24

SEQ ID NO: 39363 - protein, 145 aa, Staphylococcus aureus
  subsp. aureus IS-24
DSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKKIKIRNK

SEQ ID NO: 39364 - protein, 241 aa, Staphylococcus aureus; identical to SEQ ID NO: 30776
  subsp. aureus IS-24

SEQ ID NO: 39365 - protein, 189 aa, Staphylococcus aureus
  subsp. aureus IS-24
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQKLKR

SEQ ID NO: 39366 - protein, 895 aa, Staphylococcus aureus; identical to SEQ ID NO: 30734
  subsp. aureus IS-24

SEQ ID NO: 39367 - protein, 883 aa, Staphylococcus aureus
  subsp. aureus IS-250
MINKKNNLLTKKKPIANKSNKYAIRKFTVGTASIVIGATLLFGLGHNEAKAEENSVQDVKDSNTDDELSDSNNQSSDEEKNDVINNNQSINNVDNNQIIKKEETNNYDGIEKRSEDRTKSTTNVDENEATFLQKTPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENQTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDS

SEQ ID NO: 39368 - protein, 327 aa, Staphylococcus aureus
  subsp. aureus IS-250
MNWQRKCILTTLLVLSSLFLVFSTITYASERDFKDSLKITTHNVYFLPTAIYPNWGQSQRADLISKADYIQNQDVVILNELFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMSNNLNVSLSTQFDGNAYSWDTSSNSIAKYNYPKLEPQHLDYILLDRDHAQPSSWHNDTHRVKSPEWSVKSCGKTYKYNDYSDHYPLSGYASNE

SEQ ID NO: 39369 - protein, 681 aa, Staphylococcus aureus
  subsp. aureus IS-250
MTNNNRIKRFSIRKYAVGVVSIITGATIFIGGQQAQAAETSVQHADAHPEDSQTTQQLKNDKVEETLKASKQGNTDSQQVQTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQPLVKLQKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQTFKKVDDHTPATDKGVWQVRPVQHDWDHLDLVGMDAFDLTHTGRELGQFYLGIMDNIMRIEEADGITNK

SEQ ID NO: 39370 - protein, 154 aa, Staphylococcus aureus
  subsp. aureus IS-250
SDSDADSDSDSDSDSDSDSDSDSDSDSDSDSDSDSDSDSDSDSDSDSDSDSDADSDSDSDSDSDADSDSDSDSDSDSDSDSDADSDSDSDSDSDSDSDSDSDSDSDSDKNAKDKLPDTGANEDHDSKGTLLGTLFAGLGALLLGRRRKKDNKEK

SEQ ID NO: 39371 - protein, 2862 aa, Staphylococcus aureus
  subsp. aureus IS-250
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITQTNVNVQKKSQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKVDNATTNNQIDGIVSDSRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTYQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQKQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKISENNGIAKISEVHPETIIKRNAKQEIEQDAQSQIDTINANNKSTTEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKNVMQ

SEQ ID NO: 39372 - protein, 291 aa, Staphylococcus aureus
  subsp. aureus IS-250
MKKIDSWLTKHGLKNRLTLVVIVIFIIFLILLFMFVNLSDEDTGQITITENAELRTGPNAAYPVIYKIEKGKSFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 39373 - protein, 190 aa, Staphylococcus aureus
  subsp. aureus IS-250
MLKLKQYYLELKGYFYPISKEWDNNNLSPENIHCYVERILEYETEKYRDQKPTKEYILASSGERINEDLRRGVNNYQKILEVFDKYKTKEDITVYRTVSSRIYNLMKKNAKDLKGVDLFELGILHTSLIKGYESREDGYKLRIRVKKGTPAFYVGNLIGEESYYYEVIVVNNIKLKIISIEDHYINCEIV

SEQ ID NO: 39374 - protein, 235 aa, Staphylococcus aureus
  subsp. aureus IS-250
MKKTVIASTLAVSLGIAGYGLSGHEAHASETTNVDKEHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 39375 - protein, 101 aa, Staphylococcus aureus
  subsp. aureus IS-250
MKNSKKRLDFLPNTLNKYSIRKFTVGTASILVGATLFLGVSNEAEAAEKIDSPTKEEATTAEEPATKEEATTVEEPATKEEATTAEEPATKEEATTARRDQ

SEQ ID NO: 39376 - protein, 225 aa, Staphylococcus aureus
  subsp. aureus IS-250
MKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDVKNAQQENQNIDQEKSQEKLKSNNRTSKRLKNLQE

SEQ ID NO: 39377 - protein, 343 aa, Staphylococcus aureus
  subsp. aureus IS-250
MKDIKPNNSKLIQTYLSKKTIRYGTASALTLALYLFNSNVTAYANENTANQNQETSPKTSQTAPISNKENTDSTAVTTDQNNNDEEEYDASYELPILYVTVWLDDQGNIIKDAVEDAKTPASERQPVKIPGYQHYRTSVSDGITKFIYRKISTAQSPIVENNQQDNNTNKVVETTNQNKDEVNEKEQNQANTSVTNTQINKNEKDEDTNTPQKDKDEKDTKTPKKDREEKKPVIPKSGKDEKESKDRKTPKKDKKEKITKTPKKDREEKKPVIPKSGKDEKDTKITKKDKEDKITTTSKKDNNNDVQDKLPETGKTNDIQNPALIMLLAGLGLLGLFRNKIRE

SEQ ID NO: 39378 - protein, 490 aa, Staphylococcus aureus
  subsp. aureus IS-250
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAEQGNTGGTDKDAKVNTNDDETKTDVKNDTELPETGLSNEYDYTTTVFGSIALISSLLLLRRQRKESK

SEQ ID NO: 39379 - protein, 219 aa, Staphylococcus aureus
  subsp. aureus IS-250
MKKTLVASSLAIGLGVVAGNAGHDAHASETTNVDKAELAQKALTNDQSLNESPVQEGAYNINFDYNGNSYHFESDGSTWSWSYESTNNATQPVQPSQSQVATQQQPVQVSAPQNEQTAQPQTKSTSTSQTSSSKASSGSSVNVNSHLQQIAQRESGGDIHAINPSSGAAGKYQFLQSTWDSVAPSQYKGVSPAKAPESVQDRAAVKLYNTGGPGHWVTA

SEQ ID NO: 39380 - protein, 434 aa, Staphylococcus aureus
  subsp. aureus IS-250
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 39381 - protein, 688 aa, Staphylococcus aureus
  subsp. aureus IS-250
MKTRQNKYSIRKFSVGASSILIAALLFMGGGSAQAAEQQQDKGTVENSTTQSIGDGNEKLSEQQSTQNKNVNEKSNVNSITENESLHNETPKNEDLIQQQKDSQNDNKSESVVEQNKENEAFVQNHSEEKPQQEQVELEKHASENNQTLHSKAAQSNEDVKTKPSQLDNTAAKQEDSQKENLSKQDTQSSKTTDLLRVTAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 39382 - protein, 205 aa, Staphylococcus aureus
  subsp. aureus IS-250
MEEKFNNSQEERQFQQFQEYQKRQEEEKKKKRKKGWLFGCGGCLVLLILIIVGVTACTGTFVNEVDKEINEEGKLDKDKDTKIKSIGETTEIDGVSFTLDNASYTEERNEFADVQADKVIKVDMTVKNNSKEEIPVGGDIKVYVDGKQAKSYPIDNQLIDSLSPNREISGSEGFAINGNPKKIELEFQPLTSFSNKRYIYNIKPE

SEQ ID NO: 39383 - protein, 753 aa, Staphylococcus aureus
  subsp. aureus IS-3
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRK

SEQ ID NO: 39384 - protein, 196 aa, Staphylococcus aureus; identical to SEQ ID NO: 30587
  subsp. aureus IS-3

SEQ ID NO: 39385 - protein, 444 aa, Staphylococcus aureus; identical to SEQ ID NO: 30588
  subsp. aureus IS-3

SEQ ID NO: 39386 - protein, 938 aa, Staphylococcus aureus; identical to SEQ ID NO: 30838
  subsp. aureus IS-3

SEQ ID NO: 39387 - protein, 1015 aa, Staphylococcus aureus; identical to SEQ ID NO: 30839
  subsp. aureus IS-3

SEQ ID NO: 39388 - protein, 233 aa, Staphylococcus aureus; identical to SEQ ID NO: 30591
  subsp. aureus IS-3

SEQ ID NO: 39389 - protein, 211 aa, Staphylococcus aureus; identical to SEQ ID NO: 30592
  subsp. aureus IS-3

SEQ ID NO: 39390 - protein, 372 aa, Staphylococcus aureus; identical to SEQ ID NO: 30609
  subsp. aureus IS-3

SEQ ID NO: 39391 - protein, 241 aa, Staphylococcus aureus; identical to SEQ ID NO: 30608
  subsp. aureus IS-3

SEQ ID NO: 39392 - protein, 241 aa, Staphylococcus aureus; identical to SEQ ID NO: 30607
  subsp. aureus IS-3

SEQ ID NO: 39393 - protein, 238 aa, Staphylococcus aureus; identical to SEQ ID NO: 30606
  subsp. aureus IS-3

SEQ ID NO: 39394 - protein, 319 aa, Staphylococcus aureus; identical to SEQ ID NO: 30605
  subsp. aureus IS-3

SEQ ID NO: 39395 - protein, 154 aa, Staphylococcus aureus
  subsp. aureus IS-3
QQKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39396 - protein, 179 aa, Staphylococcus aureus; identical to SEQ ID NO: 30225
  subsp. aureus IS-3

SEQ ID NO: 39397 - protein, 268 aa, Staphylococcus aureus; identical to SEQ ID NO: 30398
  subsp. aureus IS-3

SEQ ID NO: 39398 - protein, 259 aa, Staphylococcus aureus; identical to SEQ ID NO: 30226
  subsp. aureus IS-3

SEQ ID NO: 39399 - protein, 891 aa, Staphylococcus aureus
  subsp. aureus IS-3
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEIYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 39400 - protein, 2186 aa, Staphylococcus aureus; identical to SEQ ID NO: 30789
  subsp. aureus IS-3

SEQ ID NO: 39401 - protein, 331 aa, Staphylococcus aureus; identical to SEQ ID NO: 30615
  subsp. aureus IS-3

SEQ ID NO: 39402 - protein, 231 aa, Staphylococcus aureus; identical to SEQ ID NO: 30630
  subsp. aureus IS-3

SEQ ID NO: 39403 - protein, 2481 aa, Staphylococcus aureus; identical to SEQ ID NO: 30631
  subsp. aureus IS-3

SEQ ID NO: 39404 - protein, 254 aa, Staphylococcus aureus; identical to SEQ ID NO: 30809
  subsp. aureus IS-3

SEQ ID NO: 39405 - protein, 239 aa, Staphylococcus aureus; identical to SEQ ID NO: 30622
  subsp. aureus IS-3

SEQ ID NO: 39406 - protein, 242 aa, Staphylococcus aureus; identical to SEQ ID NO: 30399
  subsp. aureus IS-3

SEQ ID NO: 39407 - protein, 131 aa, Staphylococcus aureus; identical to SEQ ID NO: 30867
  subsp. aureus IS-3

SEQ ID NO: 39408 - protein, 165 aa, Staphylococcus aureus; identical to SEQ ID NO: 30805
  subsp. aureus IS-3

SEQ ID NO: 39409 - protein, 258 aa, Staphylococcus aureus; identical to SEQ ID NO: 30410
  subsp. aureus IS-3

SEQ ID NO: 39410 - protein, 311 aa, Staphylococcus aureus; identical to SEQ ID NO: 30617
  subsp. aureus IS-3

SEQ ID NO: 39411 - protein, 327 aa, Staphylococcus aureus; identical to SEQ ID NO: 32883
  subsp. aureus IS-3

SEQ ID NO: 39412 - protein, 645 aa, Staphylococcus aureus; identical to SEQ ID NO: 30601
  subsp. aureus IS-3

SEQ ID NO: 39413 - protein, 350 aa, Staphylococcus aureus; identical to SEQ ID NO: 30602
  subsp. aureus IS-3

SEQ ID NO: 39414 - protein, 109 aa, Staphylococcus aureus; identical to SEQ ID NO: 30603
  subsp. aureus IS-3

SEQ ID NO: 39415 - protein, 165 aa, Staphylococcus aureus; identical to SEQ ID NO: 30418
  subsp. aureus IS-3

SEQ ID NO: 39416 - protein, 691 aa, Staphylococcus aureus; identical to SEQ ID NO: 30511
  subsp. aureus IS-3

SEQ ID NO: 39417 - protein, 227 aa, Staphylococcus aureus; identical to SEQ ID NO: 30586
  subsp. aureus IS-3

SEQ ID NO: 39418 - protein, 227 aa, Staphylococcus aureus; identical to SEQ ID NO: 30585
  subsp. aureus IS-3

SEQ ID NO: 39419 - protein, 232 aa, Staphylococcus aureus; identical to SEQ ID NO: 30584
  subsp. aureus IS-3

SEQ ID NO: 39420 - protein, 232 aa, Staphylococcus aureus; identical to SEQ ID NO: 30583
  subsp. aureus IS-3

SEQ ID NO: 39421 - protein, 231 aa, Staphylococcus aureus; identical to SEQ ID NO: 30582
  subsp. aureus IS-3

SEQ ID NO: 39422 - protein, 234 aa, Staphylococcus aureus; identical to SEQ ID NO: 30581
  subsp. aureus IS-3

SEQ ID NO: 39423 - protein, 292 aa, Staphylococcus aureus; identical to SEQ ID NO: 30580
  subsp. aureus IS-3

SEQ ID NO: 39424 - protein, 356 aa, Staphylococcus aureus; identical to SEQ ID NO: 30579
  subsp. aureus IS-3

SEQ ID NO: 39425 - protein, 231 aa, Staphylococcus aureus; identical to SEQ ID NO: 30578
  subsp. aureus IS-3

SEQ ID NO: 39426 - protein, 226 aa, Staphylococcus aureus; identical to SEQ ID NO: 30577
  subsp. aureus IS-3

SEQ ID NO: 39427 - protein, 203 aa, Staphylococcus aureus; identical to SEQ ID NO: 30576
  subsp. aureus IS-3

SEQ ID NO: 39428 - protein, 325 aa, Staphylococcus aureus; identical to SEQ ID NO: 30407
  subsp. aureus IS-3

SEQ ID NO: 39429 - protein, 315 aa, Staphylococcus aureus; identical to SEQ ID NO: 30573
  subsp. aureus IS-3

SEQ ID NO: 39430 - protein, 321 aa, Staphylococcus aureus; identical to SEQ ID NO: 30959
  subsp. aureus IS-3

SEQ ID NO: 39431 - protein, 351 aa, Staphylococcus aureus; identical to SEQ ID NO: 30628
  subsp. aureus IS-3

SEQ ID NO: 39432 - protein, 338 aa, Staphylococcus aureus; identical to SEQ ID NO: 30627
  subsp. aureus IS-3

SEQ ID NO: 39433 - protein, 274 aa, Staphylococcus aureus; identical to SEQ ID NO: 30815
  subsp. aureus IS-3

SEQ ID NO: 39434 - protein, 104 aa, Staphylococcus aureus
  subsp. aureus IS-3
SDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 39435 - protein, 965 aa, Staphylococcus aureus
  subsp. aureus IS-3
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSD

SEQ ID NO: 39436 - protein, 137 aa, Staphylococcus aureus; identical to SEQ ID NO: 39130
  subsp. aureus IS-3

SEQ ID NO: 39437 - protein, 654 aa, Staphylococcus aureus
  subsp. aureus IS-3
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSA

SEQ ID NO: 39438 - protein, 434 aa, Staphylococcus aureus [sequence omitted]

SEQ ID NO: 39439 - protein, 1178 aa, Staphylococcus aureus
  subsp. aureus IS-3
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDS

SEQ ID NO: 39440 - protein, 98 aa, Staphylococcus aureus
  subsp. aureus IS-3
SDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 39441 - protein, 798 aa, Staphylococcus aureus
  subsp. aureus IS-3
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDS

SEQ ID NO: 39442 - protein, 809 aa, Staphylococcus aureus; identical to SEQ ID NO: 30632
  subsp. aureus IS-3

SEQ ID NO: 39443 - protein, 141 aa, Staphylococcus aureus; identical to SEQ ID NO: 30633
  subsp. aureus IS-3

SEQ ID NO: 39444 - protein, 201 aa, Staphylococcus aureus
  subsp. aureus IS-3
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLIVRS

SEQ ID NO: 39445 - protein, 241 aa, Staphylococcus aureus; identical to SEQ ID NO: 30571
  subsp. aureus IS-3

SEQ ID NO: 39446 - protein, 681 aa, Staphylococcus aureus; identical to SEQ ID NO: 30598
  subsp. aureus IS-3

SEQ ID NO: 39447 - protein, 2271 aa, Staphylococcus aureus; identical to SEQ ID NO: 30597
  subsp. aureus IS-3

SEQ ID NO: 39448 - protein, 96 aa, Staphylococcus aureus; identical to SEQ ID NO: 30813
  subsp. aureus IS-3

SEQ ID NO: 39449 - protein, 62 aa, Staphylococcus aureus; identical to SEQ ID NO: 30610
  subsp. aureus IS-3

SEQ ID NO: 39450 - protein, 138 aa, Staphylococcus aureus; identical to SEQ ID NO: 30785
  subsp. aureus IS-3

SEQ ID NO: 39451 - protein, 291 aa, Staphylococcus aureus; identical to SEQ ID NO: 30390
  subsp. aureus IS-3

SEQ ID NO: 39452 - protein, 274 aa, Staphylococcus aureus
  subsp. aureus IS-55
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEIRDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 39453 - protein, 338 aa, Staphylococcus aureus; identical to SEQ ID NO: 31292
  subsp. aureus IS-55

SEQ ID NO: 39454 - protein, 321 aa, Staphylococcus aureus; identical to SEQ ID NO: 33860
  subsp. aureus IS-55

SEQ ID NO: 39455 - protein, 2837 aa, Staphylococcus aureus
  subsp. aureus IS-55
MNYRDKIQKFSIRKYTVGTFSTVIATLVFLGFNTSQAHAAETNQPASVVKQKQQSNNEQTENRESQVQNSQNSQNGQSLSVTHENEQPNISQANLVDQKVAQSSTTNDEQPASQNVNTKKDSATAATKQPDKEQSKHKQNESQSANKNGNDNRAAHLENHEANVVTASDSSDNGNVQHDRNELQAFFDANYHDYRFIDRENADSGTFNYVKGIFDKINTLLGSNDPINNKDLQLAYKELEQAVALIRTLPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGANKPLQQMWEYGVNDPDRSHDFKIRNRSGQVIYSWPTVHVYSLEDLSRASDYFSEAGATAATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYPTNATTNAFRPGGVQELNEYQLSQLFTDQKLQEAARTRNPIRLMIGFDYPDGYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRPNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIRPQDYVVFIPPVGKQIRAVVYYNKVVASNMSNAVTILPDDIPPTINNPVGINAKYYRGDEVNFTMGVSDRHSGIKNTTITTLPNGWTSNLTKSDNKNGSLAITGRVSMNQAFNSDITFKVSATDNVNNTTNDSQSKHVSIHVGKISEDAHPIVLGNTEKVVVVNPTAVSNDEKQRIITAFMNKNQNIRGYLASTDPVTVDNNGNVTLHYRDGSSTTLDATNVMTYEPVVKPEYQTVNAAKTATVTIAKGQSFNIGDIKQYFTLSNGQAIPNGTFTNITSDRTIPTAQEVSQMNAGTQLYHIVASNAYHKDTEDFYISLKIVDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKSQAEAGGRPNFRTTGYSQSNATTDGQRQFTLNGQVIQVLDIINPSNGYGGQPVTNSNTRANHSNSTVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPNTSQITGTVDNNHQHVSATAPNVTSATSKTINLLATDTSGNTATTSFNVTVKPLRDKYRVGTSSTAANPVRIANISNNATVSQADQTAIINSLTFTETVPNRSYARASANEITSKTVSNVSRTGNNANVTVTVTYQDGTTSTVTVPVKHVIPEIVAHSHYTVQGQDFPAGNGSSASDYFKLSNGSAIPDATITWVSGQAPNKDNTRIGEDITVTAHILIDGETTPITKTATYKVVRTVPKHVFETARGVLYPGVSDMYDAKQYVKPVNNSWSTNAQHMNFQFVGTYGPNKDVVGISTRLIRVTYDNRQTEDLTILSKVKPDPPRIDANSVTYKAGLTNQEIKVNNVLNNSSVKLFKADNTPLNVTNITHGSGFSSVVTVSDALPNGGIKAKSSISMNNVTYTTQDEHGQVVTVTRNESVDSNDSATVTVTPQLQATTEGAVFIKGGDGFDFGHVERFIQNPPHGATVAWHDSPDTWKNTVGNTHKTAVVTLPNGQGTRNVEVPVKVYPVANAKAPSRDVKGQNLTSGTDAINYITFDPNTNTNGITAAWANRQQPNNQQAGVQNLNVDVTYPGISAAKRVPVTVNVYQFEFPQTSYTTTVGGTLASGTQASGYAHMQNATGLPTDGFTYKWNNAATGTNDANWAAMNKPNVAKVVNAKYDAIYNGHTFATSLPAKFVVKDVQPSKPTVTETAAGAITIAPGANQTVNTHAGNVTTYADKLVIKRNGSVVTTFTRRNNTSPWVKEASAANVTGIVGTNNGITVAAGTFNPADTIQVVATQGSGETISDEQRSDDFTVVAPQPNQATTKIWQNGNIDITPNNPSGHLINPTQAMDIAYTEKVGNGAEHSKTLSVVRGQNNQWTIANKPDYVTLDAQTSKVTFNANTIKPNSTITITPKAGTGHSASSNPSTLTAPATHTVNTTEIVKDYGSNVTAAEINNAVQVSEKRNATIKNGTAMPTNLAGGSTTTIPVTVTYNDGSTEEVQESIYTKADKRELITAKNHLDDPVSTEGKKPGTITQYNNAMHNAQQQINTAKTEAQQVINNERATPQQVSDALTKVRAAQTKIDQAKALLQNKEDNSQLVTSKNNLQSSVNQVPSTAGMTQQSIDNYNAKKREAETEITAAQRVIDNGDATAQQISDEKHRVDNALTALNQAKHDLTADTHALEQAVQQLNRTGTTTGKKPASITAYNNSIRALQSDLTSAKNSANAIIQKPIRTVQEVQSALTNVNRVNERLTQAINQLVPLADNSALRTAKTKLDEEINKSVTTDGMTQSSIQAYENAKRAGQTESTNAQNVINNGDATDQQIATEKQK

SEQ ID NO: 39456 - protein, 200 aa, Staphylococcus aureus; identical to SEQ ID NO: 39098
  subsp. aureus IS-55

SEQ ID NO: 39457 - protein, 241 aa, Staphylococcus aureus; identical to SEQ ID NO: 30739
  subsp. aureus IS-55

SEQ ID NO: 39458 - protein, 238 aa, Staphylococcus aureus; identical to SEQ ID NO: 30740
  subsp. aureus IS-55

SEQ ID NO: 39459 - protein, 738 aa, Staphylococcus aureus
  subsp. aureus IS-55
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYFEEDTSDSDSDSDSDSDSDSDSDSDS

SEQ ID NO: 39460 - protein, 153 aa, Staphylococcus aureus
  subsp. aureus IS-55
NKPGKEDGNKPGKEDNKKPGKEDNKKPGKEDNKKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39461 - protein, 681 aa, Staphylococcus aureus; identical to SEQ ID NO: 34069
  subsp. aureus IS-55

SEQ ID NO: 39462 - protein, 43 aa, Staphylococcus aureus
  subsp. aureus IS-55
MPDTGDSIKQNGLLGGVMTLLVGLGLMKRKKKKDENDQDDSQA

SEQ ID NO: 39463 - protein, 686 aa, Staphylococcus aureus
  subsp. aureus IS-55
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNPQTLDLPQSSPQTISNAQRTSKPSVRTRAVRSLAVAEPVVNAADAKGTNVNGQVTASDFKLEKTTFDPNQSGNTFMAVNFKVAGKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSAKDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPKPTPDPEPSPDPDPDPDSDSDSDSGSDSDSGSDSDSDSDSDSDSDSDSDSDSDSDSDSDSDSDSDSDSDSNSDSDSDSESDSDSESDSDSESDSDSDSDSDSESDSDSDSDSESDSDSDSDSDS

SEQ ID NO: 39464 - protein, 291 aa, Staphylococcus aureus; identical to SEQ ID NO: 30390
  subsp. aureus IS-55

SEQ ID NO: 39465 - protein, 61 aa, Staphylococcus aureus; identical to SEQ ID NO: 33840
  subsp. aureus IS-55

SEQ ID NO: 39466 - protein, 157 aa, Staphylococcus aureus
  subsp. aureus IS-55
MKLTAIAKAALALGILTTGTLTTEVHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNVTKEKGEDAFVKGYPYYIKKEK

SEQ ID NO: 39467 - protein, 232 aa, Staphylococcus aureus; identical to SEQ ID NO: 34059
  subsp. aureus IS-55

SEQ ID NO: 39468 - protein, 232 aa, Staphylococcus aureus; identical to SEQ ID NO: 34047
  subsp. aureus IS-55

SEQ ID NO: 39469 - protein, 231 aa, Staphylococcus aureus; identical to SEQ ID NO: 34063
  subsp. aureus IS-55

SEQ ID NO: 39470 - protein, 234 aa, Staphylococcus aureus; identical to SEQ ID NO: 33390
  subsp. aureus IS-55

SEQ ID NO: 39471 - protein, 360 aa, Staphylococcus aureus
  subsp. aureus IS-55
MKITTIAKTSLALGLLTTGVITTTTQAANATTPSSTKVEAPQQTANATTPPSTKVETTQQTPNATTPSSTKVETTQAANATTPSSTKVETPQQTPNPPTSPSTKVETPQQAANATTPSSTKVEVPQSTPLSTKVEAPQSKPNATTPPSSNVDTSPPQSPTTKQVPTEINPKFKDLRAYYTKPSIEFKNEIGIILKKWTTIRFMNVVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 39472 - protein, 356 aa, Staphylococcus aureus; identical to SEQ ID NO: 34073
  subsp. aureus IS-55

SEQ ID NO: 39473 - protein, 231 aa, Staphylococcus aureus; identical to SEQ ID NO: 30578
  subsp. aureus IS-55

SEQ ID NO: 39474 - protein, 226 aa, Staphylococcus aureus; identical to SEQ ID NO: 34057
  subsp. aureus IS-55

SEQ ID NO: 39475 - protein, 203 aa, Staphylococcus aureus; identical to SEQ ID NO: 30347
  subsp. aureus IS-55

SEQ ID NO: 39476 - protein, 699 aa, Staphylococcus aureus
  subsp. aureus IS-55
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDV

SEQ ID NO: 39477 - protein, 434 aa, Staphylococcus aureus [sequence omitted]

SEQ ID NO: 39478 - protein, 149 aa, Staphylococcus aureus
  subsp. aureus IS-55
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKIKLIQQMLVRN

SEQ ID NO: 39479 - protein, 123 aa, Staphylococcus aureus
  subsp. aureus IS-55
MKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 39480 - protein, 315 aa, Staphylococcus aureus; identical to SEQ ID NO: 30440
  subsp. aureus IS-55

SEQ ID NO: 39481 - protein, 325 aa, Staphylococcus aureus; identical to SEQ ID NO: 30407
  subsp. aureus IS-55

SEQ ID NO: 39482 - protein, 632 aa, Staphylococcus aureus
  subsp. aureus IS-55
MANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 39483 - protein, 188 aa, Staphylococcus aureus
  subsp. aureus IS-55
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKNQQI

SEQ ID NO: 39484 - protein, 931 aa, Staphylococcus aureus; identical to SEQ ID NO: 34040
  subsp. aureus IS-55

SEQ ID NO: 39485 - protein, 1029 aa, Staphylococcus aureus
  subsp. aureus IS-55
MKNNLRYGIRKHKLGAASVFLGTMIVVGMGQDKEAAASEQKTTTVEENGNSATDNKVNETQTTTTNVNTIDETQSYSATATEQPSNATQVTTEKAPKAVQAPQTAQPANVETVKEEVVKEEANPQVKETTQSQDNSGDQRQVDLTPKKATQNQAAETQVEVAQPRTVSESKPRVTRSADVAEAKEASDAKVETGTDVTSKVTVESGSIEAPQGNKVEPHAGQRVVLKYKLKFEKGLHKGDYFDFTLSNNVNTYGVSTARKVPEIKNGSVVMATGQLLGNGKIRYTFTDYIDYKVNVTADLEINLFIDPKTVQSNGQQTITSTLNDKETKNTLPIEYNPGVSNSYANVNGSIETFDKGNNKFTHVAYIKPQNGHKSDSVSITGTLTQGSKANGNVPTVKVYEVLKDAKELPESVYANISDSTMFKDVTQEMKDKLKVENNGSYKLDIEKLEKSYVIHYDGEYLSGSDQVNFRTHMFGYPEQQYKYYYTHLGYQLTWDNGLVLYSNKAKGDGTNGTITESNNMTFDEEYGTGVITGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEQGGNIIDIDFDSVPQIHGFNKHNEIIEEDTNKDKPNYQFGGHNIVDFEEDTLPKVSGQNEGQQTIEEDTTPPTPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 39486 - protein, 233 aa, Staphylococcus aureus; identical to SEQ ID NO: 30428
  subsp. aureus IS-55

SEQ ID NO: 39487 - protein, 211 aa, Staphylococcus aureus; identical to SEQ ID NO: 34056
  subsp. aureus IS-55

SEQ ID NO: 39488 - protein, 78 aa, Staphylococcus aureus
  subsp. aureus IS-55
MKTRIVSSVTTTLLLGSILMNPVANAADSDINIKTGTTDIGSNTTVKTGDLVTYDKENGMHKKVFYSFIDDKNHNKNC

SEQ ID NO: 39489 - protein, 206 aa, Staphylococcus aureus; identical to SEQ ID NO: 34848
  subsp. aureus IS-55

SEQ ID NO: 39490 - protein, 165 aa, Staphylococcus aureus; identical to SEQ ID NO: 30418
  subsp. aureus IS-55

SEQ ID NO: 39491 - protein, 109 aa, Staphylococcus aureus; identical to SEQ ID NO: 33345
  subsp. aureus IS-55

SEQ ID NO: 39492 - protein, 350 aa, Staphylococcus aureus; identical to SEQ ID NO: 33885
  subsp. aureus IS-55

SEQ ID NO: 39493 - protein, 644 aa, Staphylococcus aureus; identical to SEQ ID NO: 34015
  subsp. aureus IS-55

SEQ ID NO: 39494 - protein, 311 aa, Staphylococcus aureus; identical to SEQ ID NO: 30617
  subsp. aureus IS-55

SEQ ID NO: 39495 - protein, 327 aa, Staphylococcus aureus; identical to SEQ ID NO: 34061
  subsp. aureus IS-55

SEQ ID NO: 39496 - protein, 127 aa, Staphylococcus aureus; identical to SEQ ID NO: 39318
  subsp. aureus IS-55

SEQ ID NO: 39497 - protein, 139 aa, Staphylococcus aureus
  subsp. aureus IS-55
MIDGTLFDVFVVREGTTKDATNYSIGGISKPNSKSYIDTLKNVNLKVSKKVSSNSATVASSHFEINKEEISLKELDFKLRKQLIDNHDLYKTEPKDSKITVTMNNGDYYTFELNKKLQEHRMGDVIDGTKIKEINVELN

SEQ ID NO: 39498 - protein, 227 aa, Staphylococcus aureus
  subsp. aureus IS-55
SAKDIKKIDIDVKTGSKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKINKSNNVKFPVTINKFENIVSNEFVFYNASKITINDLSIKLKSAIANDQGITKHDIELAERAVYKVYFKNGSSKYVDLKTEYKDERVFKATDIKKVDIELKF

SEQ ID NO: 39499 - protein, 991 aa, Staphylococcus aureus
  subsp. aureus IS-55
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTNHSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSD

SEQ ID NO: 39500 - protein, 187 aa, Staphylococcus aureus
  subsp. aureus IS-55
LTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 39501 - protein, 62 aa, Staphylococcus aureus; identical to SEQ ID NO: 30610
  subsp. aureus IS-55

SEQ ID NO: 39502 - protein, 138 aa, Staphylococcus aureus; identical to SEQ ID NO: 34023
  subsp. aureus IS-55

SEQ ID NO: 39503 - protein, 815 aa, Staphylococcus aureus
  subsp. aureus IS-55
MTYRMKKWQKLSTITLLMAGAITLNGGEFRSIDKNQIAVADTNVQTPDYEKLRNTWLNVNYGYDQYDEKNDAMKKKFDATEKEAEKLLSSMKTESGRTYLWDSAKDLDNKSADMTRTYRNIEKIAEAMKHKDTKLNTPDNKNKVKDALEWLHKNAYGKEPVKKLEELKTNFSKSAPQKNTNLNWWDYEIGTPRALTNTLILLKEDFTDEEKKKYTAPIKTFAPKSDEILSSVGKAEPAKGGNLVDISKVKLLESIIEEDATMMKESIEAFNKVFTYVQSNATGKERNGFYKDGSYIDHQDVPYTGAYGVVLLEGISQMMPMIKETPFKDSNQNDTTLKSWIDEGFMPLIYKGEMMDLSRGRAISRENETSHSTSATVMKSLLRLSDAMDESTKAKYKQIVKTSVKSDSSYKQNDYLSSYSDISKMKSLIEDSTISTNGLTQQLKIYNDMNRVTYHNKDLDFAFGLSMTSKNVAHYESINGENLKGWHTGAGMSYLYNSDVKHYRDNFWATADMKRLAGTTTLDNEEPKENKNSDKTFVGGTKFDDQHASIGMDFENQDKTLTAKKSYFILNDKIVFLGTGIKSTDSSKNPVTTIENRKSNGYTLFTDDKQTTASNINDQETNSVFLESTDTKKNIGYHFLNESKITVKKESHTGKWSDINKSQKSDDKTDEYYEVTQKHSNTDDKYAYVLYPGLSKDNFKSKASQVTIVKQDDDFHIVKDNESVWAGVNYSNSTQTFDINNTKVEVKAKGMFILKNKDDNTYECSFYNPESTNTASDIESKISMTGYSITNKNTSTSNESGVRFELQQTLNKDDN

SEQ ID NO: 39504 - protein, 241 aa, Staphylococcus aureus; identical to SEQ ID NO: 33853
  subsp. aureus IS-55

SEQ ID NO: 39505 - protein, 145 aa, Staphylococcus aureus
  subsp. aureus IS-55
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKN

SEQ ID NO: 39506 - protein, 231 aa, Staphylococcus aureus; identical to SEQ ID NO: 33623
  subsp. aureus IS-55

SEQ ID NO: 39507 - protein, 2473 aa, Staphylococcus aureus; identical to SEQ ID NO: 34049
  subsp. aureus IS-55

SEQ ID NO: 39508 - protein, 691 aa, Staphylococcus aureus; identical to SEQ ID NO: 34071
  subsp. aureus IS-55

SEQ ID NO: 39509 - protein, 673 aa, Staphylococcus aureus
  subsp. aureus IS-55
MTYKMKKWQKLSTITLLMAGVITLNGGEFRSIDKHQIAVADTNVQTPDYEKLRNTWLDVNYGYDKYDENNPDMKKKFDATEKEAEKLLKEMKTESDRKYLWENSKDLDTKSADMTRTYRNIEKIAEAMKHKDTKLKTDENKKKVKDALDWLHENAYGKEPDKKVKELTENFKITDSSKKKALNWWDYEIGTPRALTNTLILLNGDISSDEKKKYTAPIKTFAPDSDKILSSVGKPEQAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMISLLRLSDAMDESTKAKYKQIVKTSVKSDSSYKQNDYLSSYSDISKMKSLIEDSTISTNGLTQQLKIYNDMDRVTYHNKELDFAFGLSMTSKNVARYESINGENLKGWHTGAGMSYLYNSDVKHYRDNFWATADMTRLPGTTTLNDMPSTNTKNDNSFVGGTKFDEQHASIGMDYENQDKTLTAKKSYFILNDKIVFLGTGIKSTGSSENPITTIENRKANEYKLYKDDIENTTSNDNTQETHSVFLESSDTKKNIGYHFLDKPKISVKKKHILASGKILTTVKATLKKMMIITK

SEQ ID NO: 39510 - protein, 119 aa, Staphylococcus aureus
  subsp. aureus IS-55
MYPGLTKSDFKSKNNIVNIIKQDEDFHVIKDNDGIFAGVNYSDSTKTFDINGTKVEVKAKGMFVIKKKDDKTYECSFYNPETTNTASNIESKISIAGYTLINKSVTNSNEAGVNFELTK

SEQ ID NO: 39511 - protein, 895 aa, Staphylococcus aureus; identical to SEQ ID NO: 34054
  subsp. aureus IS-55

SEQ ID NO: 39512 - protein, 331 aa, Staphylococcus aureus; identical to SEQ ID NO: 34042
  subsp. aureus IS-55

SEQ ID NO: 39513 - protein, 132 aa, Staphylococcus aureus
  subsp. aureus IS-55
SDSDSDSESDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 39514 - protein, 274 aa, Staphylococcus aureus; identical to SEQ ID NO: 30872
  subsp. aureus IS-88

SEQ ID NO: 39515 - protein, 338 aa, Staphylococcus aureus; identical to SEQ ID NO: 30699
  subsp. aureus IS-88

SEQ ID NO: 39516 - protein, 39 aa, Staphylococcus aureus
  subsp. aureus IS-88
FRKNKDGQRLIVTYEVDWKNKTVKVVDKYSDDNKPYKEG

SEQ ID NO: 39517 - protein, 321 aa, Staphylococcus aureus; identical to SEQ ID NO: 30959
  subsp. aureus IS-88

SEQ ID NO: 39518 - protein, 327 aa, Staphylococcus aureus; identical to SEQ ID NO: 30538
  subsp. aureus IS-88

SEQ ID NO: 39519 - protein, 311 aa, Staphylococcus aureus; identical to SEQ ID NO: 30617
  subsp. aureus IS-88

SEQ ID NO: 39520 - protein, 231 aa, Staphylococcus aureus; identical to SEQ ID NO: 31073
  subsp. aureus IS-88

SEQ ID NO: 39521 - protein, 331 aa, Staphylococcus aureus; identical to SEQ ID NO: 30732
  subsp. aureus IS-88

SEQ ID NO: 39522 - protein, 1102 aa, Staphylococcus aureus; identical to SEQ ID NO: 32042
  subsp. aureus IS-88

SEQ ID NO: 39523 - protein, 241 aa, Staphylococcus aureus; identical to SEQ ID NO: 32458
  subsp. aureus IS-88

SEQ ID NO: 39524 - protein, 315 aa, Staphylococcus aureus; identical to SEQ ID NO: 30440
  subsp. aureus IS-88

SEQ ID NO: 39525 - protein, 325 aa, Staphylococcus aureus; identical to SEQ ID NO: 30407
  subsp. aureus IS-88

SEQ ID NO: 39526 - protein, 996 aa, Staphylococcus aureus; identical to SEQ ID NO: 32983
  subsp. aureus IS-88

SEQ ID NO: 39527 - protein, 204 aa, Staphylococcus aureus
  subsp. aureus IS-88
SDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 39528 - protein, 895 aa, Staphylococcus aureus; identical to SEQ ID NO: 30734
  subsp. aureus IS-88

SEQ ID NO: 39529 - protein, 2186 aa, Staphylococcus aureus
  subsp. aureus IS-88
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDGILAIKLPAEATKVSPKEIQPAPKVCTPIKKEETHESRKVEKELPNTGSEGMDLPLKEFALITGAALLARRRTKNEKES

SEQ ID NO: 39530 - protein, 657 aa, Staphylococcus aureus
  subsp. aureus IS-88
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDS

SEQ ID NO: 39531 - protein, 434 aa, Staphylococcus aureus [sequence omitted]

SEQ ID NO: 39532 - protein, 1171 aa, Staphylococcus aureus
  subsp. aureus IS-88
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSD

SEQ ID NO: 39533 - protein, 187 aa, Staphylococcus aureus
  subsp. aureus IS-88
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 39534 - protein, 227 aa, Staphylococcus aureus; identical to SEQ ID NO: 30585
  subsp. aureus IS-88

SEQ ID NO: 39535 - protein, 232 aa, Staphylococcus aureus; identical to SEQ ID NO: 30765
  subsp. aureus IS-88

SEQ ID NO: 39536 - protein, 232 aa, Staphylococcus aureus; identical to SEQ ID NO: 31054
  subsp. aureus IS-88

SEQ ID NO: 39537 - protein, 231 aa, Staphylococcus aureus; identical to SEQ ID NO: 30560
  subsp. aureus IS-88

SEQ ID NO: 39538 - protein, 231 aa, Staphylococcus aureus; identical to SEQ ID NO: 31761
  subsp. aureus IS-88

SEQ ID NO: 39539 - protein, 234 aa, Staphylococcus aureus; identical to SEQ ID NO: 31052
  subsp. aureus IS-88

SEQ ID NO: 39540 - protein, 308 aa, Staphylococcus aureus; identical to SEQ ID NO: 31787
  subsp. aureus IS-88

SEQ ID NO: 39541 - protein, 352 aa, Staphylococcus aureus; identical to SEQ ID NO: 30767
  subsp. aureus IS-88

SEQ ID NO: 39542 - protein, 231 aa, Staphylococcus aureus; identical to SEQ ID NO: 30768
  subsp. aureus IS-88

SEQ ID NO: 39543 - protein, 226 aa, Staphylococcus aureus; identical to SEQ ID NO: 30769
  subsp. aureus IS-88

SEQ ID NO: 39544 - protein, 203 aa, Staphylococcus aureus; identical to SEQ ID NO: 30770
  subsp. aureus IS-88

SEQ ID NO: 39545 - protein, 690 aa, Staphylococcus aureus; identical to SEQ ID NO: 31973
  subsp. aureus IS-88

SEQ ID NO: 39546 - protein, 372 aa, Staphylococcus aureus; identical to SEQ ID NO: 31084
  subsp. aureus IS-88

SEQ ID NO: 39547 - protein, 241 aa, Staphylococcus aureus; identical to SEQ ID NO: 30738
  subsp. aureus IS-88

SEQ ID NO: 39548 - protein, 241 aa, Staphylococcus aureus; identical to SEQ ID NO: 30739
  subsp. aureus IS-88

SEQ ID NO: 39549 - protein, 238 aa, Staphylococcus aureus; identical to SEQ ID NO: 30740
  subsp. aureus IS-88

SEQ ID NO: 39550 - protein, 319 aa, Staphylococcus aureus; identical to SEQ ID NO: 30741
  subsp. aureus IS-88

SEQ ID NO: 39551 - protein, 165 aa, Staphylococcus aureus; identical to SEQ ID NO: 30742
  subsp. aureus IS-88

SEQ ID NO: 39552 - protein, 109 aa, Staphylococcus aureus; identical to SEQ ID NO: 30744
  subsp. aureus IS-88

SEQ ID NO: 39553 - protein, 350 aa, Staphylococcus aureus; identical to SEQ ID NO: 30602
  subsp. aureus IS-88

SEQ ID NO: 39554 - protein, 645 aa, Staphylococcus aureus; identical to SEQ ID NO: 30747
  subsp. aureus IS-88

SEQ ID NO: 39555 - protein, 241 aa, Staphylococcus aureus; identical to SEQ ID NO: 30776
  subsp. aureus IS-88

SEQ ID NO: 39556 - protein, 236 aa, Staphylococcus aureus
  subsp. aureus IS-88
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEE

SEQ ID NO: 39557 - protein, 783 aa, Staphylococcus aureus; identical to SEQ ID NO: 36484
  subsp. aureus IS-88

SEQ ID NO: 39558 - protein, 242 aa, Staphylococcus aureus; identical to SEQ ID NO: 31991
  subsp. aureus IS-88

SEQ ID NO: 39559 - protein, 242 aa, Staphylococcus aureus; identical to SEQ ID NO: 31992
  subsp. aureus IS-88

SEQ ID NO: 39560 - protein, 157 aa, Staphylococcus aureus
  subsp. aureus IS-88
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 39561 - protein, 233 aa, Staphylococcus aureus; identical to SEQ ID NO: 30428
  subsp. aureus IS-88

SEQ ID NO: 39562 - protein, 236 aa, Staphylococcus aureus
  subsp. aureus IS-88
AQAPKADNKFNKEQQNAFYEILHLPNLTEEQRNGFIQSLKDDPSVSKEILAEAKKLNDAQAPKEEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39563 - protein, 995 aa, Staphylococcus aureus; identical to SEQ ID NO: 31038
  subsp. aureus IS-88

SEQ ID NO: 39564 - protein, 917 aa, Staphylococcus aureus; identical to SEQ ID NO: 31037
  subsp. aureus IS-88

SEQ ID NO: 39565 - protein, 188 aa, Staphylococcus aureus; identical to SEQ ID NO: 39483
  subsp. aureus IS-88

SEQ ID NO: 39566 - protein, 250 aa, Staphylococcus aureus; identical to SEQ ID NO: 31910
  subsp. aureus IS-88

SEQ ID NO: 39567 - protein, 291 aa, Staphylococcus aureus; identical to SEQ ID NO: 30390
  subsp. aureus IS-88

SEQ ID NO: 39568 - protein, 96 aa, Staphylococcus aureus; identical to SEQ ID NO: 30813
  subsp. aureus IS-88

SEQ ID NO: 39569 - protein, 321 aa, Staphylococcus aureus; identical to SEQ ID NO: 39082
  subsp. aureus IS-88

SEQ ID NO: 39570 - protein, 681 aa, Staphylococcus aureus; identical to SEQ ID NO: 32025
  subsp. aureus IS-88

SEQ ID NO: 39571 - protein, 2271 aa, Staphylococcus aureus; identical to SEQ ID NO: 32024
  subsp. aureus IS-88

SEQ ID NO: 39572 - protein, 610 aa, Staphylococcus aureus
  subsp. aureus IS-88
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSES

SEQ ID NO: 39573 - protein, 807 aa, Staphylococcus aureus; identical to SEQ ID NO: 30716
  subsp. aureus IS-88

SEQ ID NO: 39574 - protein, 141 aa, Staphylococcus aureus; identical to SEQ ID NO: 30715
  subsp. aureus IS-88

SEQ ID NO: 39575 - protein, 325 aa, Staphylococcus aureus; identical to SEQ ID NO: 30484
  subsp. aureus IS-88

SEQ ID NO: 39576 - protein, 235 aa, Staphylococcus aureus
  subsp. aureus IS-88
MQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 39577 - protein, 327 aa, Staphylococcus aureus; identical to SEQ ID NO: 30538
  subsp. aureus IS-91

SEQ ID NO: 39578 - protein, 311 aa, Staphylococcus aureus; identical to SEQ ID NO: 30617
  subsp. aureus IS-91

SEQ ID NO: 39579 - protein, 231 aa, Staphylococcus aureus; identical to SEQ ID NO: 31073
  subsp. aureus IS-91

SEQ ID NO: 39580 - protein, 372 aa, Staphylococcus aureus; identical to SEQ ID NO: 31084
  subsp. aureus IS-91

SEQ ID NO: 39581 - protein, 241 aa, Staphylococcus aureus; identical to SEQ ID NO: 30738
  subsp. aureus IS-91

SEQ ID NO: 39582 - protein, 200 aa, Staphylococcus aureus
  subsp. aureus IS-91
MNNNITKKIILSTTLLLLGTASTQFPNTPINSSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKNYIIILIIKDKLK

SEQ ID NO: 39583 - protein, 238 aa, Staphylococcus aureus; identical to SEQ ID NO: 30740
  subsp. aureus IS-91

SEQ ID NO: 39584 - protein, 319 aa, Staphylococcus aureus; identical to SEQ ID NO: 30741
  subsp. aureus IS-91

SEQ ID NO: 39585 - protein, 165 aa, Staphylococcus aureus; identical to SEQ ID NO: 30742
  subsp. aureus IS-91

SEQ ID NO: 39586 - protein, 54 aa, Staphylococcus aureus
  subsp. aureus IS-91
MDAQKAVNFFKRTRTVATHRKAQRAVNLIHFQHSYEKKKLQRQIDLVLKYNTLK

SEQ ID NO: 39587 - protein, 350 aa, Staphylococcus aureus; identical to SEQ ID NO: 30602
  subsp. aureus IS-91

SEQ ID NO: 39588 - protein, 645 aa, Staphylococcus aureus; identical to SEQ ID NO: 30747
  subsp. aureus IS-91

SEQ ID NO: 39589 - protein, 193 aa, Staphylococcus aureus
  subsp. aureus IS-91
MNKIFRVLTVSLFFFTFLIKNNLAYADVGVINLRNFYTNYQPETLQGVSSGNFSTSHQLEYIDGKYTLYSQFHNEYEAKRLKDHKVDIFGISYSGLCNTKYMYGGITLANQNLDKPRNIPINLWVNGKQNTISTDEVSTQKKEVTAQEIDIKLRKYLQNEYNIYGFNKTKKVRNMDISQNLILDLTKEKLLSI

SEQ ID NO: 39590 - protein, 242 aa, Staphylococcus aureus; identical to SEQ ID NO: 31991
  subsp. aureus IS-91

SEQ ID NO: 39591 - protein, 261 aa, Staphylococcus aureus
  subsp. aureus IS-91
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 39592 - protein, 61 aa, Staphylococcus aureus; identical to SEQ ID NO: 33840
  subsp. aureus IS-91

SEQ ID NO: 39593 - protein, 157 aa, Staphylococcus aureus; identical to SEQ ID NO: 38930
  subsp. aureus IS-91

SEQ ID NO: 39594 - protein, 232 aa, Staphylococcus aureus; identical to SEQ ID NO: 30765
  subsp. aureus IS-91

SEQ ID NO: 39595 - protein, 232 aa, Staphylococcus aureus; identical to SEQ ID NO: 31054
  subsp. aureus IS-91

SEQ ID NO: 39596 - protein, 231 aa, Staphylococcus aureus; identical to SEQ ID NO: 30560
  subsp. aureus IS-91

SEQ ID NO: 39597 - protein, 59 aa, Staphylococcus aureus; identical to SEQ ID NO: 39289
  subsp. aureus IS-91

SEQ ID NO: 39598 - protein, 171 aa, Staphylococcus aureus; identical to SEQ ID NO: 39288
  subsp. aureus IS-91

SEQ ID NO: 39599 - protein, 234 aa, Staphylococcus aureus; identical to SEQ ID NO: 31052
  subsp. aureus IS-91

SEQ ID NO: 39600 - protein, 298 aa, Staphylococcus aureus
  subsp. aureus IS-91
MKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKITRKSHGRCHRWH

SEQ ID NO: 39601 - protein, 352 aa, Staphylococcus aureus; identical to SEQ ID NO: 30767
  subsp. aureus IS-91

SEQ ID NO: 39602 - protein, 231 aa, Staphylococcus aureus; identical to SEQ ID NO: 30768
  subsp. aureus IS-91

SEQ ID NO: 39603 - protein, 226 aa, Staphylococcus aureus; identical to SEQ ID NO: 30769
  subsp. aureus IS-91

SEQ ID NO: 39604 - protein, 203 aa, Staphylococcus aureus; identical to SEQ ID NO: 30770
  subsp. aureus IS-91

SEQ ID NO: 39605 - protein, 690 aa, Staphylococcus aureus; identical to SEQ ID NO: 31973
  subsp. aureus IS-91

SEQ ID NO: 39606 - protein, 624 aa, Staphylococcus aureus
  subsp. aureus IS-91
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDS

SEQ ID NO: 39607 - protein, 2271 aa, Staphylococcus aureus; identical to SEQ ID NO: 32024
  subsp. aureus IS-91

SEQ ID NO: 39608 - protein, 681 aa, Staphylococcus aureus; identical to SEQ ID NO: 32025
  subsp. aureus IS-91

SEQ ID NO: 39609 - protein, 321 aa, Staphylococcus aureus; identical to SEQ ID NO: 30959
  subsp. aureus IS-91

SEQ ID NO: 39610 - protein, 315 aa, Staphylococcus aureus; identical to SEQ ID NO: 30440
  subsp. aureus IS-91

SEQ ID NO: 39611 - protein, 325 aa, Staphylococcus aureus; identical to SEQ ID NO: 30407
  subsp. aureus IS-91

SEQ ID NO: 39612 - protein, 196 aa, Staphylococcus aureus; identical to SEQ ID NO: 30587
  subsp. aureus IS-91

SEQ ID NO: 39613 - protein, 444 aa, Staphylococcus aureus; identical to SEQ ID NO: 32034
  subsp. aureus IS-91

SEQ ID NO: 39614 - protein, 917 aa, Staphylococcus aureus; identical to SEQ ID NO: 31037
  subsp. aureus IS-91

SEQ ID NO: 39615 - protein, 995 aa, Staphylococcus aureus; identical to SEQ ID NO: 31038
  subsp. aureus IS-91

SEQ ID NO: 39616 - protein, 325 aa, Staphylococcus aureus; identical to SEQ ID NO: 30484
  subsp. aureus IS-91

SEQ ID NO: 39617 - protein, 115 aa, Staphylococcus aureus
  subsp. aureus IS-91
MSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 39618 - protein, 109 aa, Staphylococcus aureus
  subsp. aureus IS-91
MQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQKFKKVFNGE

SEQ ID NO: 39619 - protein, 250 aa, Staphylococcus aureus; identical to SEQ ID NO: 31910
  subsp. aureus IS-91

SEQ ID NO: 39620 - protein, 291 aa, Staphylococcus aureus; identical to SEQ ID NO: 30390
  subsp. aureus IS-91

SEQ ID NO: 39621 - protein, 657 aa, Staphylococcus aureus; identical to SEQ ID NO: 38419
  subsp. aureus IS-91

SEQ ID NO: 39622 - protein, 119 aa, Staphylococcus aureus; identical to SEQ ID NO: 38421
  subsp. aureus IS-91

SEQ ID NO: 39623 - protein, 141 aa, Staphylococcus aureus; identical to SEQ ID NO: 30715
  subsp. aureus IS-91

SEQ ID NO: 39624 - protein, 804 aa, Staphylococcus aureus
  subsp. aureus IS-91
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDS

SEQ ID NO: 39625 - protein, 476 aa, Staphylococcus aureus
  subsp. aureus IS-91
HYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 39626 - protein, 670 aa, Staphylococcus aureus
  subsp. aureus IS-91
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSD

SEQ ID NO: 39627 - protein, 434 aa, Staphylococcus aureus [sequence omitted]

SEQ ID NO: 39628 - protein, 895 aa, Staphylococcus aureus; identical to SEQ ID NO: 30734
  subsp. aureus IS-91

SEQ ID NO: 39629 - protein, 1005 aa, Staphylococcus aureus
  subsp. aureus IS-91
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDVTEDEIQDALNQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKMPSIKVRKRNIIRYLIIMMRRSKNNKQHNNYLIKL

SEQ ID NO: 39630 - protein, 808 aa, Staphylococcus aureus
  subsp. aureus IS-91
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDIFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 39631 - protein, 1184 aa, Staphylococcus aureus
  subsp. aureus IS-91
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDS

SEQ ID NO: 39632 - protein, 142 aa, Staphylococcus aureus
  subsp. aureus IS-91
SDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 39633 - protein, 96 aa, Staphylococcus aureus; identical to SEQ ID NO: 30813
  subsp. aureus IS-91

SEQ ID NO: 39634 - protein, 330 aa, Staphylococcus aureus; identical to SEQ ID NO: 30381
  subsp. aureus IS-91

SEQ ID NO: 39635 - protein, 338 aa, Staphylococcus aureus; identical to SEQ ID NO: 30699
  subsp. aureus IS-91

SEQ ID NO: 39636 - protein, 351 aa, Staphylococcus aureus; identical to SEQ ID NO: 30720
  subsp. aureus IS-91

SEQ ID NO: 39637 - protein, 1102 aa, Staphylococcus aureus; identical to SEQ ID NO: 32042
  subsp. aureus IS-91

SEQ ID NO: 39638 - protein, 331 aa, Staphylococcus aureus; identical to SEQ ID NO: 30732
  subsp. aureus IS-91

SEQ ID NO: 39639 - protein, 233 aa, Staphylococcus aureus; identical to SEQ ID NO: 38970
  subsp. aureus IS-91

SEQ ID NO: 39640 - protein, 151 aa, Staphylococcus aureus
  subsp. aureus IS-91
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 39641 - protein, 241 aa, Staphylococcus aureus; identical to SEQ ID NO: 30776
  subsp. aureus IS-91

SEQ ID NO: 39642 - protein, 201 aa, Staphylococcus aureus; identical to SEQ ID NO: 39444
  subsp. aureus IS-91

SEQ ID NO: 39643 - protein, 158 aa, Staphylococcus aureus
  subsp. aureus IS-91
SDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 39644 - protein, 225 aa, Staphylococcus aureus; identical to SEQ ID NO: 30763
  subsp. aureus IS-91

SEQ ID NO: 39645 - protein, 282 aa, Staphylococcus aureus
  subsp. aureus IS-91
ILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39646 - protein, 231 aa, Staphylococcus aureus; identical to SEQ ID NO: 30630
  subsp. aureus IS-99

SEQ ID NO: 39647 - protein, 2481 aa, Staphylococcus aureus
  subsp. aureus IS-99
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSHMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 39648 - protein, 911 aa, Staphylococcus aureus
  subsp. aureus IS-99
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 39649 - protein, 434 aa, Staphylococcus aureus [sequence omitted]

SEQ ID NO: 39650 - protein, 321 aa, Staphylococcus aureus; identical to SEQ ID NO: 30959
  subsp. aureus IS-99

SEQ ID NO: 39651 - protein, 315 aa, Staphylococcus aureus
  subsp. aureus IS-99
MLKNKILATTLSVSLLAPLANPLLENAKAANDTEGIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 39652 - protein, 325 aa, Staphylococcus aureus; identical to SEQ ID NO: 30407
  subsp. aureus IS-99

SEQ ID NO: 39653 - protein, 196 aa, Staphylococcus aureus; identical to SEQ ID NO: 30587
  subsp. aureus IS-99

SEQ ID NO: 39654 - protein, 215 aa, Staphylococcus aureus
  subsp. aureus IS-99
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKIK

SEQ ID NO: 39655 - protein, 938 aa, Staphylococcus aureus
  subsp. aureus IS-99
MIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIARPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 39656 - protein, 126 aa, Staphylococcus aureus
  subsp. aureus IS-99
PTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 39657 - protein, 227 aa, Staphylococcus aureus; identical to SEQ ID NO: 30586
  subsp. aureus IS-99

SEQ ID NO: 39658 - protein, 227 aa, Staphylococcus aureus; identical to SEQ ID NO: 30585
  subsp. aureus IS-99

SEQ ID NO: 39659 - protein, 232 aa, Staphylococcus aureus; identical to SEQ ID NO: 30584
  subsp. aureus IS-99

SEQ ID NO: 39660 - protein, 232 aa, Staphylococcus aureus; identical to SEQ ID NO: 30583
  subsp. aureus IS-99

SEQ ID NO: 39661 - protein, 231 aa, Staphylococcus aureus; identical to SEQ ID NO: 30582
  subsp. aureus IS-99

SEQ ID NO: 39662 - protein, 234 aa, Staphylococcus aureus; identical to SEQ ID NO: 30581
  subsp. aureus IS-99

SEQ ID NO: 39663 - protein, 292 aa, Staphylococcus aureus; identical to SEQ ID NO: 30580
  subsp. aureus IS-99

SEQ ID NO: 39664 - protein, 356 aa, Staphylococcus aureus; identical to SEQ ID NO: 30579
  subsp. aureus IS-99

SEQ ID NO: 39665 - protein, 231 aa, Staphylococcus aureus; identical to SEQ ID NO: 30578
  subsp. aureus IS-99

SEQ ID NO: 39666 - protein, 226 aa, Staphylococcus aureus; identical to SEQ ID NO: 30577
  subsp. aureus IS-99

SEQ ID NO: 39667 - protein, 203 aa, Staphylococcus aureus; identical to SEQ ID NO: 30576
  subsp. aureus IS-99

SEQ ID NO: 39668 - protein, 691 aa, Staphylococcus aureus; identical to SEQ ID NO: 30511
  subsp. aureus IS-99

SEQ ID NO: 39669 - protein, 241 aa, Staphylococcus aureus; identical to SEQ ID NO: 30571
  subsp. aureus IS-99

SEQ ID NO: 39670 - protein, 259 aa, Staphylococcus aureus
  subsp. aureus IS-99
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLAEAKKLNDAQAPKADNKFNKEQQNAFYEILHLPNLTEEQRNGFIQSLKDDPSVSKEIFSRS

SEQ ID NO: 39671 - protein, 1406 aa, Staphylococcus aureus
  subsp. aureus IS-99
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKKKHLQLLTKLKRIVR

SEQ ID NO: 39672 - protein, 331 aa, Staphylococcus aureus; identical to SEQ ID NO: 30615
  subsp. aureus IS-99

SEQ ID NO: 39673 - protein, 327 aa, Staphylococcus aureus; identical to SEQ ID NO: 30616
  subsp. aureus IS-99

SEQ ID NO: 39674 - protein, 234 aa, Staphylococcus aureus
  subsp. aureus IS-99
MQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 39675 - protein, 73 aa, Staphylococcus aureus
  subsp. aureus IS-99
MFKKKMLAATLSVGLIAPLASPIQESRANTNIENIGDGAEVIKRTEDVSSKKWGVTQNVQFDFVKDKNITKML

SEQ ID NO: 39676 - protein, 258 aa, Staphylococcus aureus; identical to SEQ ID NO: 30410
  subsp. aureus IS-99

SEQ ID NO: 39677 - protein, 131 aa, Staphylococcus aureus; identical to SEQ ID NO: 30867
  subsp. aureus IS-99

SEQ ID NO: 39678 - protein, 242 aa, Staphylococcus aureus; identical to SEQ ID NO: 30399
  subsp. aureus IS-99

SEQ ID NO: 39679 - protein, 239 aa, Staphylococcus aureus; identical to SEQ ID NO: 30622
  subsp. aureus IS-99

SEQ ID NO: 39680 - protein, 254 aa, Staphylococcus aureus; identical to SEQ ID NO: 30809
  subsp. aureus IS-99

SEQ ID NO: 39681 - protein, 62 aa, Staphylococcus aureus; identical to SEQ ID NO: 30610
  subsp. aureus IS-99

SEQ ID NO: 39682 - protein, 138 aa, Staphylococcus aureus; identical to SEQ ID NO: 30785
  subsp. aureus IS-99

SEQ ID NO: 39683 - protein, 291 aa, Staphylococcus aureus; identical to SEQ ID NO: 30390
  subsp. aureus IS-99

SEQ ID NO: 39684 - protein, 321 aa, Staphylococcus aureus
  subsp. aureus IS-99
MKNKKRVLIASSLSCAILLLSAATTQANSAHKDSQDQNKKEHVDKSQQKDKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKIKMVKG

SEQ ID NO: 39685 - protein, 338 aa, Staphylococcus aureus; identical to SEQ ID NO: 30627
  subsp. aureus IS-99

SEQ ID NO: 39686 - protein, 274 aa, Staphylococcus aureus; identical to SEQ ID NO: 30815
  subsp. aureus IS-99

SEQ ID NO: 39687 - protein, 159 aa, Staphylococcus aureus
  subsp. aureus IS-99
DSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 39688 - protein, 647 aa, Staphylococcus aureus
  subsp. aureus IS-99
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSE

SEQ ID NO: 39689 - protein, 2271 aa, Staphylococcus aureus
  subsp. aureus IS-99
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSVSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 39690 - protein, 681 aa, Staphylococcus aureus; identical to SEQ ID NO: 30598
  subsp. aureus IS-99

SEQ ID NO: 39691 - protein, 809 aa, Staphylococcus aureus; identical to SEQ ID NO: 30632
  subsp. aureus IS-99

SEQ ID NO: 39692 - protein, 141 aa, Staphylococcus aureus; identical to SEQ ID NO: 30633
  subsp. aureus IS-99

SEQ ID NO: 39693 - protein, 160 aa, Staphylococcus aureus
  subsp. aureus IS-99
KPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39694 - protein, 165 aa, Staphylococcus aureus; identical to SEQ ID NO: 30418
  subsp. aureus IS-99

SEQ ID NO: 39695 - protein, 109 aa, Staphylococcus aureus; identical to SEQ ID NO: 30603
  subsp. aureus IS-99

SEQ ID NO: 39696 - protein, 350 aa, Staphylococcus aureus; identical to SEQ ID NO: 30602
  subsp. aureus IS-99

SEQ ID NO: 39697 - protein, 645 aa, Staphylococcus aureus; identical to SEQ ID NO: 30601
  subsp. aureus IS-99

SEQ ID NO: 39698 - protein, 233 aa, Staphylococcus aureus; identical to SEQ ID NO: 30591
  subsp. aureus IS-99

SEQ ID NO: 39699 - protein, 211 aa, Staphylococcus aureus; identical to SEQ ID NO: 30592
  subsp. aureus IS-99

SEQ ID NO: 39700 - protein, 1337 aa, Staphylococcus aureus; identical to SEQ ID NO: 30811
  subsp. aureus IS-99

SEQ ID NO: 39701 - protein, 138 aa, Staphylococcus aureus
  subsp. aureus IS-99
SDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 39702 - protein, 259 aa, Staphylococcus aureus; identical to SEQ ID NO: 30226
  subsp. aureus IS-99

SEQ ID NO: 39703 - protein, 268 aa, Staphylococcus aureus; identical to SEQ ID NO: 30398
  subsp. aureus IS-99

SEQ ID NO: 39704 - protein, 164 aa, Staphylococcus aureus
  subsp. aureus IS-99
MVISPLNVKANENIDSVKEKELHKKSELSSTALNNMKHSYADKNPIIGENKSTGDQFLENTLLYKKFFTDLINFEDLLINFNSKEMAQHFKSKNVDVYAIRYSINCYGGEIDRTACTYGGVTPHEGNKLKERKKIPINLWINGVQKEVSLDKVQTDKKMLPYKN

SEQ ID NO: 39705 - protein, 126 aa, Staphylococcus aureus
  subsp. aureus IS-99
SDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 39706 - protein, 891 aa, Staphylococcus aureus; identical to SEQ ID NO: 30788
  subsp. aureus IS-99

SEQ ID NO: 39707 - protein, 372 aa, Staphylococcus aureus; identical to SEQ ID NO: 30609
  subsp. aureus IS-99

SEQ ID NO: 39708 - protein, 241 aa, Staphylococcus aureus; identical to SEQ ID NO: 30608
  subsp. aureus IS-99

SEQ ID NO: 39709 - protein, 200 aa, Staphylococcus aureus
  subsp. aureus IS-99
MNNNITKKIILSTTLLLLGTAFTQFPNTPINSSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKNYIIILIIKDKLK

SEQ ID NO: 39710 - protein, 238 aa, Staphylococcus aureus; identical to SEQ ID NO: 30606
  subsp. aureus IS-99

SEQ ID NO: 39711 - protein, 319 aa, Staphylococcus aureus; identical to SEQ ID NO: 30605
  subsp. aureus IS-99

SEQ ID NO: 39712 - protein, 786 aa, Staphylococcus aureus
  subsp. aureus IS-99
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDS

SEQ ID NO: 39713 - protein, 90 aa, Staphylococcus aureus
  subsp. aureus IS-K
MKNSKKRLDFLPNTLNKYSIRKFTVGTASILVGATLFLGVSNEAEAAEKIDSPTKEEATTAEEPATKEEATTAEEPATKEEATTAEEPAT

SEQ ID NO: 39714 - protein, 815 aa, Staphylococcus aureus
  subsp. aureus IS-K
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNLDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 39715 - protein, 235 aa, Staphylococcus aureus; identical to SEQ ID NO: 39374
  subsp. aureus IS-K

SEQ ID NO: 39716 - protein, 688 aa, Staphylococcus aureus; identical to SEQ ID NO: 39381
  subsp. aureus IS-K

SEQ ID NO: 39717 - protein, 219 aa, Staphylococcus aureus; identical to SEQ ID NO: 39379
  subsp. aureus IS-K

SEQ ID NO: 39718 - protein, 3692 aa, Staphylococcus aureus
  subsp. aureus IS-K
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITQTNVNVQKKSQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKVDNATTNNQIDGIVSDSRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTYQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQKQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKISENNGIAKISEVHPETIIKRNAKQEIEQDAQSQIDTINANNKSTTEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDAQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRAHKQIDEAETFVSIETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 39719 - protein, 291 aa, Staphylococcus aureus; identical to SEQ ID NO: 39372
  subsp. aureus IS-K

SEQ ID NO: 39720 - protein, 434 aa, Staphylococcus aureus; identical to SEQ ID NO: 39380
  subsp. aureus IS-K

SEQ ID NO: 39721 - protein, 728 aa, Staphylococcus aureus
  subsp. aureus IS-K
MKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGNRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 39722 - protein, 681 aa, Staphylococcus aureus; identical to SEQ ID NO: 39369
  subsp. aureus IS-K

SEQ ID NO: 39723 - protein, 1682 aa, Staphylococcus aureus
  subsp. aureus IS-K
MFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSVSTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEIVKKDFIVDYGNKKDNTTTAAVANVDNVNNKHNEVVYLNQNNQNPKYANYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSGQDITVDSNGITTTGVINGADNLTIDSGFYKTPKYSVGDYVWKDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDADSDSDSDSDSDSDSDSDADSDSDSDSDSDADSDSDSDSDSDSDSDSDSDSDSDSDSDSDSDSDSDSDSDSDSDADSDSDADSDSDSDSDSDADSDSDSDSDSDADSDSDSDSDSDADSDSDSDSDSDSDSDSDADSDSDSDSDSDSDSDSDSDSDSDADSDSDSDSDSDADSDSDSDSDSDSDSDSDADSDSDSDSDSDSDSDSDSDSDSDSDSDSDADSDSDSDSDSDSDSDSDSDSDSDSDSDSDADSDADSDSDADSDSDSDSDSDSDSDSDADSDSDSDSDSDSDSDSDSDSDSDSDSDSDSDSDSDADSDSDSDSDSDSDSDSDADSDSDSDSDSDADSDSDSDSDSDADSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDADSDSDSDSDSDSDSDSDSDSDSDSDKNAKDKLPDTGANEDHDSKGTLLGTLFAGLGALLLGRRRKKDNKEK

SEQ ID NO: 39724 - protein, 327 aa, Staphylococcus aureus
  subsp. aureus IS-K
MNWQRKCILTTLLVLSSLFLVFSTITYASERDFKDSLKITTHNVYFLPTAIYPNWGQSQRADLISKADYIQNQDVVILNELFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMSNNLNVSLSTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 39725 - protein, 343 aa, Staphylococcus aureus; identical to SEQ ID NO: 39377
  subsp. aureus IS-K

SEQ ID NO: 39726 - protein, 205 aa, Staphylococcus aureus; identical to SEQ ID NO: 39382
  subsp. aureus IS-K

SEQ ID NO: 39727 - protein, 190 aa, Staphylococcus aureus; identical to SEQ ID NO: 39373
  subsp. aureus IS-K

SEQ ID NO: 39728 - protein, 891 aa, Staphylococcus aureus; identical to SEQ ID NO: 30788
  subsp. aureus IS-M

SEQ ID NO: 39729 - protein, 141 aa, Staphylococcus aureus; identical to SEQ ID NO: 30633
  subsp. aureus IS-M

SEQ ID NO: 39730 - protein, 809 aa, Staphylococcus aureus; identical to SEQ ID NO: 30632
  subsp. aureus IS-M

SEQ ID NO: 39731 - protein, 152 aa, Staphylococcus aureus
  subsp. aureus IS-M
MSKEILAEAKKLNDAQAPKEEDNKKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39732 - protein, 817 aa, Staphylococcus aureus
  subsp. aureus IS-M
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSD

SEQ ID NO: 39733 - protein, 645 aa, Staphylococcus aureus; identical to SEQ ID NO: 30601
  subsp. aureus IS-M

SEQ ID NO: 39734 - protein, 165 aa, Staphylococcus aureus; identical to SEQ ID NO: 30418
  subsp. aureus IS-M

SEQ ID NO: 39735 - protein, 109 aa, Staphylococcus aureus; identical to SEQ ID NO: 30603
  subsp. aureus IS-M

SEQ ID NO: 39736 - protein, 350 aa, Staphylococcus aureus; identical to SEQ ID NO: 30602
  subsp. aureus IS-M

SEQ ID NO: 39737 - protein, 179 aa, Staphylococcus aureus; identical to SEQ ID NO: 30225
  subsp. aureus IS-M

SEQ ID NO: 39738 - protein, 259 aa, Staphylococcus aureus; identical to SEQ ID NO: 30226
  subsp. aureus IS-M

SEQ ID NO: 39739 - protein, 268 aa, Staphylococcus aureus; identical to SEQ ID NO: 30398
  subsp. aureus IS-M

SEQ ID NO: 39740 - protein, 905 aa, Staphylococcus aureus; identical to SEQ ID NO: 30600
  subsp. aureus IS-M

SEQ ID NO: 39741 - protein, 434 aa, Staphylococcus aureus [sequence omitted]

SEQ ID NO: 39742 - protein, 319 aa, Staphylococcus aureus; identical to SEQ ID NO: 30605
  subsp. aureus IS-M

SEQ ID NO: 39743 - protein, 241 aa, Staphylococcus aureus; identical to SEQ ID NO: 30608
  subsp. aureus IS-M

SEQ ID NO: 39744 - protein, 241 aa, Staphylococcus aureus; identical to SEQ ID NO: 30607
  subsp. aureus IS-M

SEQ ID NO: 39745 - protein, 238 aa, Staphylococcus aureus; identical to SEQ ID NO: 30606
  subsp. aureus IS-M

SEQ ID NO: 39746 - protein, 211 aa, Staphylococcus aureus; identical to SEQ ID NO: 30592
  subsp. aureus IS-M

SEQ ID NO: 39747 - protein, 325 aa, Staphylococcus aureus; identical to SEQ ID NO: 30407
  subsp. aureus IS-M

SEQ ID NO: 39748 - protein, 233 aa, Staphylococcus aureus; identical to SEQ ID NO: 30591
  subsp. aureus IS-M

SEQ ID NO: 39749 - protein, 315 aa, Staphylococcus aureus; identical to SEQ ID NO: 30573
  subsp. aureus IS-M

SEQ ID NO: 39750 - protein, 321 aa, Staphylococcus aureus; identical to SEQ ID NO: 30959
  subsp. aureus IS-M

SEQ ID NO: 39751 - protein, 731 aa, Staphylococcus aureus
  subsp. aureus IS-M
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 39752 - protein, 959 aa, Staphylococcus aureus
  subsp. aureus IS-M
MIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 39753 - protein, 162 aa, Staphylococcus aureus
  subsp. aureus IS-M
QTQIAILDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 39754 - protein, 992 aa, Staphylococcus aureus
  subsp. aureus IS-M
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDS

SEQ ID NO: 39755 - protein, 274 aa, Staphylococcus aureus; identical to SEQ ID NO: 30815
  subsp. aureus IS-M

SEQ ID NO: 39756 - protein, 351 aa, Staphylococcus aureus; identical to SEQ ID NO: 30628
  subsp. aureus IS-M

SEQ ID NO: 39757 - protein, 338 aa, Staphylococcus aureus; identical to SEQ ID NO: 30627
  subsp. aureus IS-M

SEQ ID NO: 39758 - protein, 372 aa, Staphylococcus aureus; identical to SEQ ID NO: 30609
  subsp. aureus IS-M

SEQ ID NO: 39759 - protein, 169 aa, Staphylococcus aureus
  subsp. aureus IS-M
SESDSDSDSDSDSDQIQTAIRFSSDSDSDSDSDSDSDSDSDSDSDSDSDSDSDNDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 39760 - protein, 1197 aa, Staphylococcus aureus
  subsp. aureus IS-M
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSD

SEQ ID NO: 39761 - protein, 242 aa, Staphylococcus aureus; identical to SEQ ID NO: 30399
  subsp. aureus IS-M

SEQ ID NO: 39762 - protein, 131 aa, Staphylococcus aureus; identical to SEQ ID NO: 30867
  subsp. aureus IS-M

SEQ ID NO: 39763 - protein, 258 aa, Staphylococcus aureus; identical to SEQ ID NO: 30410
  subsp. aureus IS-M

SEQ ID NO: 39764 - protein, 327 aa, Staphylococcus aureus; identical to SEQ ID NO: 30616
  subsp. aureus IS-M

SEQ ID NO: 39765 - protein, 306 aa, Staphylococcus aureus; identical to SEQ ID NO: 30803
  subsp. aureus IS-M

SEQ ID NO: 39766 - protein, 165 aa, Staphylococcus aureus; identical to SEQ ID NO: 30805
  subsp. aureus IS-M

SEQ ID NO: 39767 - protein, 254 aa, Staphylococcus aureus; identical to SEQ ID NO: 30809
  subsp. aureus IS-M

SEQ ID NO: 39768 - protein, 239 aa, Staphylococcus aureus; identical to SEQ ID NO: 30622
  subsp. aureus IS-M

SEQ ID NO: 39769 - protein, 263 aa, Staphylococcus aureus
  subsp. aureus IS-M
MVEIVLKKRTKPIKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETATVEPMPQSKPTTSEAPPSQNNHNENNMYDASTE

SEQ ID NO: 39770 - protein, 138 aa, Staphylococcus aureus; identical to SEQ ID NO: 30785
  subsp. aureus IS-M

SEQ ID NO: 39771 - protein, 291 aa, Staphylococcus aureus; identical to SEQ ID NO: 30390
  subsp. aureus IS-M

SEQ ID NO: 39772 - protein, 62 aa, Staphylococcus aureus; identical to SEQ ID NO: 30610
  subsp. aureus IS-M

SEQ ID NO: 39773 - protein, 96 aa, Staphylococcus aureus; identical to SEQ ID NO: 30813
  subsp. aureus IS-M

SEQ ID NO: 39774 - protein, 125 aa, Staphylococcus aureus
  subsp. aureus IS-M
DSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 39775 - protein, 231 aa, Staphylococcus aureus; identical to SEQ ID NO: 30578
  subsp. aureus IS-M

SEQ ID NO: 39776 - protein, 231 aa, Staphylococcus aureus; identical to SEQ ID NO: 30582
  subsp. aureus IS-M

SEQ ID NO: 39777 - protein, 227 aa, Staphylococcus aureus; identical to SEQ ID NO: 30586
  subsp. aureus IS-M

SEQ ID NO: 39778 - protein, 232 aa, Staphylococcus aureus
  subsp. aureus IS-M
MKFTAIAKAIFVLGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDVFSIDEFFFIQKEEVSLKELDFKIRKLLIKKYKLYEGSADKGRIVINMKDENKYEIDLSDKLDFERMADVINSEQIKNIEVNLK

SEQ ID NO: 39779 - protein, 226 aa, Staphylococcus aureus; identical to SEQ ID NO: 30577
  subsp. aureus IS-M

SEQ ID NO: 39780 - protein, 257 aa, Staphylococcus aureus
  subsp. aureus IS-M
MNMKTIAKTSLALGLLTTGAITVTTQSVKAEKIQSTKVDKVPTLKAERLAMINITAGANSATTQAANTRQERTPKLEKAPNTNEEKTSASKIEKISQPKQEEQKSLNISAMPAPKQEQSQTTTESTTPKTKVTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKS

SEQ ID NO: 39781 - protein, 241 aa, Staphylococcus aureus; identical to SEQ ID NO: 30571
  subsp. aureus IS-M

SEQ ID NO: 39782 - protein, 232 aa, Staphylococcus aureus; identical to SEQ ID NO: 30584
  subsp. aureus IS-M

SEQ ID NO: 39783 - protein, 691 aa, Staphylococcus aureus; identical to SEQ ID NO: 30511
  subsp. aureus IS-M

SEQ ID NO: 39784 - protein, 224 aa, Staphylococcus aureus
  subsp. aureus IS-M
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAF

SEQ ID NO: 39785 - protein, 67 aa, Staphylococcus aureus
  subsp. aureus IS-M
MKELDFKLRKQLIENHNLYGNVGSGKIVINMKNGGKYTFELHKKLQENRMADVIDGTNIDNIEVNIK

SEQ ID NO: 39786 - protein, 203 aa, Staphylococcus aureus; identical to SEQ ID NO: 30576
  subsp. aureus IS-M

SEQ ID NO: 39787 - protein, 234 aa, Staphylococcus aureus; identical to SEQ ID NO: 30581
  subsp. aureus IS-M

SEQ ID NO: 39788 - protein, 227 aa, Staphylococcus aureus; identical to SEQ ID NO: 30585
  subsp. aureus IS-M

SEQ ID NO: 39789 - protein, 67 aa, Staphylococcus aureus
  subsp. aureus IS-M
MKELDFKLRKQLIEKHNLYGNMGSGTIVIKMKNGGKYTFELHKKLQEHRMADVIEGTNIDKIEVNIK

SEQ ID NO: 39790 - protein, 145 aa, Staphylococcus aureus; identical to SEQ ID NO: 33455
  subsp. aureus IS-M

SEQ ID NO: 39791 - protein, 659 aa, Staphylococcus aureus
  subsp. aureus IS-M
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSD

SEQ ID NO: 39792 - protein, 2271 aa, Staphylococcus aureus; identical to SEQ ID NO: 30597
  subsp. aureus IS-M

SEQ ID NO: 39793 - protein, 127 aa, Staphylococcus aureus
  subsp. aureus IS-M
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKNSSLNNKNIQRDTTKK

SEQ ID NO: 39794 - protein, 2501 aa, Staphylococcus aureus
  subsp. aureus IS-M
MNLFRQQKFIIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 39795 - protein, 231 aa, Staphylococcus aureus; identical to SEQ ID NO: 30630
  subsp. aureus IS-M

SEQ ID NO: 39796 - protein, 321 aa, Staphylococcus aureus
  subsp. aureus LGA251
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDFKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 39797 - protein, 315 aa, Staphylococcus aureus
  subsp. aureus LGA251
MLKNKILATTLSVSLLAPLANPLLENAKAANDTEDIGKGSDIEIIKRTEDKTSNKWGVTQNIQFDFVKDKKYNKDALILKMQGFISSRTTYYNYKKTNHIKAMRWPFQYNISLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 39798 - protein, 325 aa, Staphylococcus aureus
  subsp. aureus LGA251
MNMNKLVKSSVATSMALLLLSNTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 39799 - protein, 155 aa, Staphylococcus aureus; identical to SEQ ID NO: 30258
  subsp. aureus LGA251

SEQ ID NO: 39800 - protein, 965 aa, Staphylococcus aureus
  subsp. aureus LGA251
MIVVGMGQEKEAAASEQNNITVEESGNSATESKASETQTTTNNVNTIDETQSYSATSTEQPSQSTQVTTEEAPTTVQAPKVETSRVDLPSEKVADKETTGTQVDTTQQSNASEIKPRMKRSADVAEMAEKEVVGEAKTTGSDVTNKVTVENGSEIVGHKQDTNVVNPHNAERVTLKYKWKFGEGIKAGDYFDFTLSDNVETHGISTLRKVPEIKSSTEDKVMANGQVIGERKIRYTFTDYIDNKKDLTAELTLNLFIDPTTVTKQGMEKVEVSLGQNKVSKEFDIKYLDGVKDRMGVTVNGRIDTLNKADGKFSHFAYVKPNNQSLSSVTVTGQVTSGYKQNAKNPTVKVYKHIGSDELAESVYAKLDDANKFEDVTNKVNLSYTGDGGYSLNFNDLDNTKNYVIKYEGEYDQNAKDLNFRTHLSGYHKNYLYSPYYPYYPVQLTWNNGVAFYSNKAQGDGKDKPNDPIIEKSEPIELDIKSEPPVEKHELTGTIEESNDSKPIDFEYHTAVEGSEGHAEGIVETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSADFEEDTLPKVSGQNEGQQTIEEDTTPPTPEVPSEPETPMPPTPEVPSEPGEPTPPTPEVPSEPETPTPPTPEVPSEPETPTPPTPEVPSEPGEPTPPTPEVPSEPETPTPPTPEVPSEPETPTPPTPEVPSEPGESTPPTPEVPAEPGKPVPPAKEEPKKTSKPVEQGKVVTPVIEINEKVKAVAPTKKAQSKKSELPETGGEESTNKGMLFGGLFSILGLALLRRNKKNHKA

SEQ ID NO: 39801 - protein, 1017 aa, Staphylococcus aureus
  subsp. aureus LGA251
MIVVGMGQDKEAAASEQKTTTVEENGNSATDNKTSETQTTATNVNHIEETQSYNATATEQPSNATQVTTEEAPKAVQAPQTAQPANLETVKEEVVKEEAKPQVKETTQPQDNSGDQKQVDLTPKMATQNQAAETQVEVAQPRTVSESNPRVTRSADVVEAKEVSEVKGTDVTSKVTVESGSIEGHNNTNKVEPHAGQRAVLKYKLKFENGLHQGDYFDFTLSNNVNTHGVSTVRKVPDILNGSLVMATGKVLGEGKIRYTFTDYINNKVNVTANLEINLFIDPKTVQDNGNQKITSMINDHETEKTIPISYNPGVSNTYANINGSIETFNKADNKFTHVAYIIPKNGMSTESATITGTLMKGSNSNGNSPTVKIFEVLESNKELPKSVYANITDTNTFKDVTSQMKDNLTVSENGSYSLNIENLNKTYVVHYSGEYLSGSHEVDFRTQMTGHPKQQSIYYYNHGYTLTWDNGLVLYSNKANGDGKYGPIVDSNNFEFSEDSGNGSISGRYDEKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIQGQNNGNQSFEEDTEKDKPKYEQGGNIIDIDFDSVPHIHGFNKHNETIEEDTNKDKPNYQFGGHNSVDFEEDTLPKVSGQNEGQQTIEEDTTPPTPEVPSEPETPTPPTPEVPSEPGKPTPPTPEVPSEPETPTPPTPEVPGEPETPPTPTPPTPEVPSEPGTPVPPTPEVPAEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 39802 - protein, 233 aa, Staphylococcus aureus
  subsp. aureus LGA251
MKKTIMASSLAVALGVTGYAASTGHEAHAAEMNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 39803 - protein, 214 aa, Staphylococcus aureus
  subsp. aureus LGA251
MNKMKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTSNNSAVNPSIKANDVHTKSNKQMAKQQSIHLDSKSKSGHKQQLKELPKTGVNNESNTAIMALFIGLILLVVSLVTRFIKLNSYK

SEQ ID NO: 39804 - protein, 515 aa, Staphylococcus aureus
  subsp. aureus LGA251
MKKKNIYSIRKLGVGIASVTLGTLLISGGVTPAANAAQHDEAQQNAIYQVLNMPNLNADQRNGFIQSLKDDPSQSANVLGEAKKLNDSQAPKADAQQNNFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNKPGKEDNNKPGKEDGNKPGKEDGNKPGKEDGNKPSKEDDNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39805 - protein, 993 aa, Staphylococcus aureus
  subsp. aureus LGA251
MKKRIDYLSNKQNKYSIRRFTVGTTSVIVGATILFGIGNHQAQASEQSNDTTQSSKNNASADSEKNNTIETPQLNTTANDTSDISANTNSANVDRTAKPMSTQTSNTTTTEPASTNETPQPTAIKDQATAAKMQDRTVPQEANSQVDNKTTNDANSITTNSELKNPQTLDLPQSSPQTISNAQGTSKPSVRTRAVRSLAVAEPVVNAADAKGTNVNDKVTASNLQLQKTTFDPNQSGNTFMAANFTVTDKVKSGDYFTAKLPDSLTGNGDVDYSNSNNTMPIADIKSTNGDVVAKATYDILTKTYTFVFTDYVNEKENINGQFSLPLFTDRAKAPKSGTYPANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDITKTYVVLVEGHYDNTGKNLKTQVIQENIDPATGKDYSIFGWNNENVVRYGGGSADGDSAVNPKDPTPGPPVDPEPEPEPTPDPEPSLDPDPEPTPDPEPSPEPDPDSDSDSDSGSDSDSGSDSDSGSDSDSGSDSDSGSDSDSDSDSNSDSDSESDSDSDSGSDSDLDSDSESDSDSDSDSDSDSGSDSDSGSDSDSGSDSDSDSDSNSDSDSESDSDSDSGSDSDLDSDSESDSDSDSDSDSDSDSDSDSDSDSDSDSDSDSDSDSESDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSESDSDSDSDSDSESDSDSDSDSDSDSDSDSDSDSDSDSDSRVTPPNNEQKAPSNPKGEVNHSNKASKQHKTDALPETGDKSENTNATLFGAMMALLGSLLLFRKRKQDHKEKA

SEQ ID NO: 39806 - protein, 2206 aa, Staphylococcus aureus
  subsp. aureus LGA251
MSKRQKEFHDSLANEKTRVRLYKSGKNWVKSGIKEIEMFKIMGLPFISHSMVSQDNQSISKKMTGYGLKTTAVIGGAFTVNMLHDQQAFAASDAPLTSELNTQSETVGNQNSTTIDASTSTADSTSVTKNSSSVQTSNSDTVSSEKSENVTSTTNSTSNQQEKLTSTSESTSSKNTTSSSDTKSVASTSSTEQPINTSTNQSTASNNTSQSTTPSSANLNKTSTTSTSTAPVKLRTFSRLAMSTFASAATTTALTANTITVNKDNLKQYMTTSGNATYDQSTGIVTLTQDTYSQKGAITLGTRIDSNKSFHFSGKVNLGNKYEGHGNGGDGIGFAFSPGVLGETGLNGAAVGIGGLSNAFGFKLDTYHNTSTPNSAAKAKADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPAVTPIGDKSSEVFSPISPVKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIMTSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESGSTSESISISNSISNSVSASTSKSDSQSTSISLSTSDSKSMSTSESLSDSTSTSDSVSGSLSVAGSQSVSTSTSDSMSTSEMISDSMSTSGSLAASDSKSMSVSSSMSTSQSGSTSESLSDSISTSDSDSKSLSLSTSQSGSTSTSTSTSSSVRMSESQSTSGSMSTSQSDSTSISTSFSDSTSDSKSASTASSESISQSVSTSTSGSVSTSTSLSTSNSERTSTSMSDSTSLSTSESDSISESTSTSDSISEAISASESTSISLSESNSISDSESQSASAFLSESLSVSTSESTSESVSSSTSASTSLSDSTSESGSTSTSLSNSTSGSASISTSTSGSASTSTVKSESVSTSLSTSTSTSLSDSTSLSTSLSDSTSGSKSNSLSASMSTSDSISTRKSESLSASTSLSDSKSASMQSSESDSQSTSTSLSNSQSTSTSNRMSTIASESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESISLSGSQSMSDSVSTSDSSSLSVSTSQRSSESVSESDSLSDSKSTSGSTSTSTSGSLSTSTSLSGSESVSESSSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISSSISVSDSSSASTSESLSDSMAQSQSTSTSASGSLSTSISLSMSASASTSTSQSTSVSTSLSTSDSISDSTSISISGSQSAVESESTSDSTSISDSESLSTSGSTSGSTSISTSESLSSSNSGSTSVSESLSTSNSGSTSVSDSSSTSSSLSTSGSTSVSDSTSMSESNSASISMSQSISGSTSGSTSISTSESLSMSGSTHNSTSVSDSDSISTSNSGSMSNSIRHFTSLSTSGLMSLSDSNSMSNSTSTSMSDSTSMSDSESVPTSASTSLSTSNSESASVSMSDSTSTSMSNSTSMSDSDSVSISASESMSASMSDSVSMSDSTSSSMSNSMSMSTSESNSIHPSNSMSTSQTHFTSTSISTSESIAPNTNESQSTLSATSVSSKHDAEPAQREERLPDTGDSIKQNGLLGGVMTLLVGLGLMKRKKKKDENDQDDSQA

SEQ ID NO: 39807 - protein, 681 aa, Staphylococcus aureus
  subsp. aureus LGA251
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRTKEALPLNKSNQTSQREIVNKSEIEKVQPQQNNQANDKITNYNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 39808 - protein, 996 aa, Staphylococcus aureus
  subsp. aureus LGA251
MNKNVLKFMVFIMLLNIITPLFNKNDALAARDISSTNVTDLTVSPSKIEDGGKTTVKMTFDDKNRKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKSYVSKDITIKDQIQGGQQLDLSTLNINVTGTHSNYYSGPNAITDFEKAFPGSKITVDNAKNTIDVTIPQGYGSYNSFSINYKTKITNEQQKEFVNNSQAWYQEHGKEEVNGKSFNHTVHNINANAGIEGTVKGELKVLKQDKDTKAPIVNVKFKLSKKDGSVVKANQKEIEIITDANGIANIKALPSGDYILKEIEAPAPYTFDKDKEYPFTMKDTDNQGYFTTIENAKAIEKTKDVSAQKVWEGTQKVKPTIYFKLYKQDDNQNTTPVDKAEIKKLEDGTTKVTWSNLPENDKNGKTIKYLVKEVNAQGEDTTPEGYTKNENGLVVTNTEKPIETTSISGEKVWDDKDNQDGKRPEKVSVNLLANGEKVNTLDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVETVDVTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPEKPNKPIYPEKPKDKTPPNKPDHSNKVKPTPPDEPSKVDKVDQPKDNKTKPENPLKELPKTGMKIITSWITWVFIGILGLYLILRKRFNS

SEQ ID NO: 39809 - protein, 691 aa, Staphylococcus aureus
  subsp. aureus LGA251
MLRGQEERKYSIRKYSIGVVSVLAATMFVVTSHEAQASEKTPTTNAAAQKETLNQPGEQGNAITSHQMQSGKQLDDMHKENGKSGTVTEGKDTLQSSKHQSTQNSKTIRTQNDNQVKQDSERQGSRQSHQNNAINKTERQNDQVQNTHHAERNGSQSTTSQSNDVDKSQPSIPAQKVIPNHDKAAPTSTTPPSNDKTAPKSTKTQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHDNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATEGKGTQLKAS

SEQ ID NO: 39810 - protein, 203 aa, Staphylococcus aureus; identical to SEQ ID NO: 30658
  subsp. aureus LGA251

SEQ ID NO: 39811 - protein, 226 aa, Staphylococcus aureus; identical to SEQ ID NO: 34402
  subsp. aureus LGA251

SEQ ID NO: 39812 - protein, 231 aa, Staphylococcus aureus
  subsp. aureus LGA251
MKMKNIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 39813 - protein, 369 aa, Staphylococcus aureus
  subsp. aureus LGA251
MKMTTIAKTSLALGLLTTGAITVTTQSVKAEKVQSTKVDKVPTLKAERLAMINITTGANTGTTQATNTEQERTPKLEKAPNTNEEKNSASKIEKISQPKQEAQKSLNISATQAPKQEQSQTITESTTQQTKVTTPPSTNTQQTKVTIPPSTNAPQPMQSTKSDTPQSPTIKQAQTDITPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHDLYGNMGSGTIVIKMKNGGKYTFELHKRLQEHRMADVIEGTNIDKIEVNIK

SEQ ID NO: 39814 - protein, 347 aa, Staphylococcus aureus
  subsp. aureus LGA251
MKITTIAKTSLALGLLTTGVITTTTQAANATTPSSTKVEKPQQAANATTPSSTKVEAPKQTPNATTPSSTKVEAPQQTPNATTPPSTKVETPQQTPNATTPSSIKVETPHQTPNATTPPSTKVETPQQTPSATTPSSTKVETPQSPTTKQVPTEINPKFKNLRAYYTKPSLEFKNEIGIILKKWTTIRFMNIVPDYFIYKIALVGKDDNKYGEGVHRNVDVFVVLEENNYNLEKYSVGGITKSNSKKVDHKAGVRITKEDNKGTISHDVSEFKITKEQISLKELDFKLRKQLVENHNLYGNVGSGKIVIKMKNGGKYTFELHKKLQEDRMADVIDGTNIDNIEVNIK

SEQ ID NO: 39815 - protein, 234 aa, Staphylococcus aureus
  subsp. aureus LGA251
MKMTAIAKASLALGILATGIITSTHQTVNASEHEAKYENVTKDIFDLRDYYSGASKELKNVTGYRYSKGGKHYLIFDKHQKFTRIQIFGKDIERLKTRKNPGLDIFVVKEAENRNGTVFSYGGVTKKNQGAYYDYLNAPKFVIKKEVDAGVYTHVKRHYIYKEEVSLKELDFKLRQYLIQNFDLYKKFPKDSKIKVIMKDGGYYTFELNKKLQTNRMSDVIDGRNIEKIEASIR

SEQ ID NO: 39816 - protein, 231 aa, Staphylococcus aureus
  subsp. aureus LGA251
MKLKTLAKATLALGLLTTGVITSEGQAVHAKEKQERVQHLYDIKDLHRYYSSESFEFSNISGKVENYNGSNVVRFNQKGQNHQLFLLGKDKEEYKEGIEGKDVFVVKELIDPNGRLSTVGGVTKKNNQSSETNTPLVVNKVYGGDLHASIDSFSINKEEVSLKELDFKIRKQLVEKYGLYQGTSKYGKITIILNDGKKEVIDLGDKLQFERMGDVLNSKDINKIEVTLKQI

SEQ ID NO: 39817 - protein, 232 aa, Staphylococcus aureus
  subsp. aureus LGA251
MKFTAIAKAIFVLGILTTSVMITENQSVNAKGKYEKMNRLYDTNKLHQYYSGPSYELTNVSGQSQSYYDSNVLLFNQQNQKFQVFLLGKDENKYKEKTHGLDVFAVPELVDLDGRIFSVSGVTKKNVKSIFESLRTPNLLVKKIDDKGGFSIDEFFFVQKEEVSLKELDFKIRKLLIKKYKLYEGSADKGRIVINMKDENKYEIDLSDKLDFERMADVISSEQIKNIEVNLK

SEQ ID NO: 39818 - protein, 232 aa, Staphylococcus aureus
  subsp. aureus LGA251
MKFTALAKATLALGILTTGVFTAESKAVHAKVELDETQRKYYINMLHQYYSEESFEPTNISVKSEDYYGSNVLNFKQRNKVFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTADKGRIVINMKDEKKHEIDLSEKLSFERMFDVMDSKKIKNIEVNLN

SEQ ID NO: 39819 - protein, 227 aa, Staphylococcus aureus; identical to SEQ ID NO: 33477
  subsp. aureus LGA251

SEQ ID NO: 39820 - protein, 231 aa, Staphylococcus aureus
  subsp. aureus LGA251
MKLKNIAKASLALGILTTGMITTTAQPVKAKSMDSSLTAISNDTKKLKDYYTGDSFDYKNLKGYREGNIATFIFNSQQIDVTLTENEKNKFEDGNGIQNVDVFVVREGSGRQATDYSIGGISKTNGDNYKDYVNRPHIEVKREKGMVTTVKSDTDFYINKEEISLKELDFKLRKHLIDKHDLYKTEPKDSKIRITMKNGGYYTFELNKKLQPHRMGDTIDSRNIEKIEVNL

SEQ ID NO: 39821 - protein, 1359 aa, Staphylococcus aureus
  subsp. aureus LGA251
MLNRENKTAMTRKGMVSNRLNKFSIRKYTVGTASILVGTTLIFGLGNQEAKAAESTNKELNEATTSASDNQSNSKVDNQQLNQEDNTKNDNQKEMVSSQGNETTSNGNKSIEKESVQSTTGNKVEVSTAKSDEQASPKSTNEDLNTKQTISNQEALQSDLQENKSVVNVQPTNEENKKVDAKTESTTLNVKSDAIKSNVETLVDNNSNSNNENNADIILPKSTEPKRLNTRMRIAAIQPNSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVSRDNNSIGSAFTETVSHAGNAEDPGYYKQTVYVNPSEKSLTNAKLKVEAYHKDYADNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQELGEVGVKGVTVVVYDNKTNKEVGRTITDEKGGYLIPNLPNGDYRVEFSNLPQGYEVTPSKQGNNEELDSNGVSSVITVNGKDNLSADLGIYKPKYNLGDYVWEDINKNGIQDQDEKGISGVTVTLKDENGNVLKTVTTDADGKYKFTDLDNGNYKVEFTTPEGYTPTSTNTGGNDTVDSNGLTTTGVINGADNMTLDSGFYKTPKYNLGNYVWEDTNKDGKQDSSEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFENPAGLTQTGTNTTEDDKDADGGEVDVTITDHDDFTLDNGYFEEETSDSDSDSDSDSDSGSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGTHTPVKPMSTTKDHHNKAKALPETGSENNGSNNATLFGGLFAALGSLLLFGRRKKQNK

SEQ ID NO: 39822 - protein, 1135 aa, Staphylococcus aureus
  subsp. aureus LGA251
MINRDNKKAITKKGMISNRLNKFSIRKYTVGTASILVGTTLIFGLGNQEAKAAENTSTENAKQDDATTSDNKEVVSETENNSTTENNSTNPIKKERNTDSQPEAKEESTTSSTQQQQNNVTATTETKPQNIEKENVKPSTDKTATEDTSVILEEKKAPNNTNNDVTTKSSTSEIQTKPTTPQESTNIENSQPQPTPSKVDNQVTDATNPKEPVNVSKEELKNNPEKLKELVRNDSNTDRSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKTATNTKVDIAGSQVDDYGNIKLGNGSTIIDQNTEIKVYKVNSNQQLPQSNRIYDFSQYEDVTSQFDNKKSFSNNVATLDFGNIDSAYIIKVVSKYTPTSDGELDIAQGTSMRTTDNYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 39823 - protein, 434 aa, Staphylococcus aureus [sequence omitted]

SEQ ID NO: 39824 - protein, 1019 aa, Staphylococcus aureus
  subsp. aureus LGA251
MNMKKKEKHAIRKKSIGVASVLVGTLIGFGLLSSKEADASENSVTQSDSASNESKSSDSSSVNAAPKTDNTNVSDTKTTSNTNNGETSVAQNLAQQETTQSASTNATTEETPVTGEATTTATNQANTPATTQSSNTNAEELVNQTSNETTSNDTNNVSSVNSPQNSTNAENVSTTQDTSTEATPSNNESAPQSTDASNKDVVNQAVNTSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDTKNDVKATLTVPAYIDPENVTKTGNVTLTTGIGTNTDSKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSGSDSNSDSGSDSGSDSTSDSGSDSASDSDSTSDSDSTSDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSESDSDSDSDSDSDSASDSESDSDSDSDSDSDSASDSNSGSDSDSSSDSDSGSDSDSSSDSESDSDSDSDSDSDSASDSDSGSDSDSSSDSDSDSASDSDSDSDSASDSDSGSDSDSSSDSESDSDSDSDSDSDSASDSDSGSDSDSDSDSESDSDSDSDSDSDSDSDSDSGSNNNVVPPNSPKNGTNAFNKNEAKDSKEPLPDTGSEGEANTSLIWGLLASLGSLLLFRRKKENKDKK

SEQ ID NO: 39825 - protein, 641 aa, Staphylococcus aureus
  subsp. aureus LGA251
MNKQQKEFKSFYSIRKSSLGVASVAISTLLLLMSNSEAQAAEETGGTNTEAQPKTEAVASPSTTTEKAPEAKPVANAVSVSNKEVEAPTSETKEAKEVKAPKETKEVKPGAKADNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSAEKFKTEEDYKAEKLLAPYKKAKTLERQVYELNKIQDKLPEKLKAEYKKKLEETKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYIEGKTLYDAIVKVHVKTIDYDGQYHVRIVDKEAFTKANADKSNKKEQQDNSAKKETTPAKPSKPTPSPVEKESQKQDSQKDDNKQSPSVEKENDASSESGKDKTPSTKPAKAEVESSSTTPTKVVSTTQNVAKPTTASSETTIDVVQTSAGSSEAKDSAPLQKANIKNTNDGHTQSQNNKNTQENKAKSLPQTGEESNKDMTLPLMAFLALSSIVAFVLPRKHKN

SEQ ID NO: 39826 - protein, 354 aa, Staphylococcus aureus
  subsp. aureus LGA251
MTKHYLNSKYQSEQRSSAMKKITMGTASIILGYLVYIGADSQQVNAATEATNATNNQSAQVSQATSQPINFQVQKDGSSEKSHMDDYMQHPGKVIKQNNKYYFQAVLNNASFWKEYKFYNANNQELATTVVNDDKKADTRTINVAVEPGYKSLTTKVHIVVPQINYNHRYTTHLEFEKAIPTLADAAKPNNVKPVQPKPAQPKTPTEQTKPVQPKIEKVKPTVTTTSKVEDNHSTKVVSTDTTKDQTKTQSAHTVKTTQTAQEQNKVQTPVKDVATAKSESNNQAVSDNKSQQTNKVTKQNEVHKQETSKDSKAKELPKTGLTSVDNFISTVAFATLALLGSLSLLLFKRKESK

SEQ ID NO: 39827 - protein, 109 aa, Staphylococcus aureus; identical to SEQ ID NO: 33345
  subsp. aureus LGA251

SEQ ID NO: 39828 - protein, 165 aa, Staphylococcus aureus; identical to SEQ ID NO: 31315
  subsp. aureus LGA251

SEQ ID NO: 39829 - protein, 238 aa, Staphylococcus aureus
  subsp. aureus LGA251
MNKNITKNIILTTTLLLLGTVLPQNQKPVFSFYSEAKAYSIAQDETNINELIKYYTQPHFSFSNKWLYQYDNGNIYVELKRYSWSAHISLWGAESWGNINQLKDRYVDVFGLKDKDTDQLWWSYRETFTGGVTPAAKLSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 39830 - protein, 241 aa, Staphylococcus aureus
  subsp. aureus LGA251
MNNNITKKIILSTTLLLLGTASTQLPNTPISSSTEAKAYYINQNETNVNELTKYYSQQHLTFSNKTLWQKDNGTIHATLLQFSWYSHIQVYGPESWGNINQLRNKNVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAQIEVILEKSN

SEQ ID NO: 39831 - protein, 241 aa, Staphylococcus aureus
  subsp. aureus LGA251
MKKNIMNKLVLSTALLLLGTTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLTLTDTNRYVKNPKNAQIEVILEKSN

SEQ ID NO: 39832 - protein, 229 aa, Staphylococcus aureus
  subsp. aureus LGA251
MTNSASAIEYSDLHHKSKFDSKHLYNAKVSFANPTQLENKKTNDRLLKHDLLFHDMFVNDAWKKDFKVEFENEALSKKFINKDIDIFAGNYGYGCHGGATNKTQCSYGGVTLSDNNKYDDYKNIPCNLWIDGRQTEIELTAVKTKKKIVTIQELDVQLRNYLSEKYKLYEKGGDIVKGYVKYHNDDEKNVEYDFYNLNGEYGHEVLKMYADNKTINSDKLHLDIYLFKS

SEQ ID NO: 39833 - protein, 291 aa, Staphylococcus aureus
  subsp. aureus LGA251
MKKIEAWLSKKGLKNKRTLIVVIAFVLFIIFLFLLLNSNSKDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFST

SEQ ID NO: 39834 - protein, 890 aa, Staphylococcus aureus; identical to SEQ ID NO: 33523
  subsp. aureus LGA251

SEQ ID NO: 39835 - protein, 2185 aa, Staphylococcus aureus
  subsp. aureus LGA251
MNLLKKNKYSIRKYKVGIFSTLIGTVLLLSNPNGAQALTTDNNVQSDTNQATPVNSQDTNVANNRGLINSAQNTPNQSATTNQSTNQALVNHNNGSIANQATPAPIQPSASPAQNNNHSDANSTATETVSNANNNDVVSNNTTLNVPNRTNENGSGGHLTLKEIQEDVRHSSDKPELVAIAEQASNRPKKRSRRAAPADPNATPADPAAAAANGTVPAGNTAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPDNVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNGLKRRAQTILDENRNNVPLNKRVSQADIDSLTNQMQHTLIRSVDAENAVNKKVDQMEDLVNQNDELTDEEKQAAIQVIEEHKNEIIGDIGDQTTDAGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKDAALNELTQATNHALEQINQATTNADVDNAKGDGLNAINPIAPVTVVKQAARDAVSHDAQQHIAEINANPDATQEERQAAIDKVNAAVTAANTNILNANTNANVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGGVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQIPNATDEEKQAAVNQINQLKDQAFNQINQNQTNDQVDATTNQAVNAIDNVEAEVVIKPKAIADIEKAVKEKQQQIDNSLDSTDNEKEVASQALTKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPEHIVRAGARDAVKQQYEAKKQEIEQAEHATDEEKQVALNQLANNEKLALQNINQAVTNNDVKRVETNGIATLKGVQPHIVIKPEAQQAIKASAENQVESIKDTPHATVDELDEANQLISDTLKKAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNAAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDVEKTINDDLARVTALVQNYRKVSDRNKADALKAITALKLQMDEELKTARTNADVDAVLKRFNVALGDIEAVITEKENSLLRIDNIAQQTYAKFKAIATPEQLAKVKVLIDQYVADGNRMIDEDATLNDIKQHTQFIVDEILAIKLPAEATKVSPKVIQSAPKVCTPIKKEETHESRKVEKELPNTGSEGMDLPLKEFALITGAALLARRRTKNEKES

SEQ ID NO: 39836 - protein, 331 aa, Staphylococcus aureus
  subsp. aureus LGA251
MSNQFKSEEERRQWEQFQAFQNQQNQQNQQYGQKKSKKGWFWGCGGCLVLFILIIIGISACTAGVTGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVSYEASATTPAKTSSADTDSEDSEKSSKDEDNQNASKSDKSSVGKSESNEETAPVEPMPHSKPTTSEAPPSQNIHNEDSMYDASTE

SEQ ID NO: 39837 - protein, 804 aa, Staphylococcus aureus
  subsp. aureus LGA251
MTYRMKKWQKLSTITLLMAGVITLNNGEFRNVDKHQIAVADTNVQTPDYEKLKKTWLDVNYGYNQYDENNQDMKKKFDAKEKEAKKLLDDMKTDTNRTYLWSGAENLETNSSHMTKTYRNIEKIAEAMRQKNTVLNTDENKLKIKEALDWMHKNVYGKNPSQKVEDLTKNRKGQTTPKNNSLNWWDYEIGTPKSLTNTLLLMDDTLTKDEMINYSKPISIYSPSSDKILSSVGESEDAKGGNLVDISKVKLLESVIEEDVDMMKNSIDSFNKVFSYVQDSATGKARNGFYKDGSYIDHQDVPYTGAYGVVLLEGISQMMPMIKESPFKTTKDNATLSNWIDEGFMPLIYKGEMMDLSRGRAISRENETSHTASATVMKSLLRLSDAMDDSTKSKYKKIVKTSVESDSSYKQNDYLNSYSDIDKMKKLMDDKSISTNGLTQQLKIYNNMDRVTYHNKDLDFALGLSMTSKNIARYENINGENLKGWHTGAGMSYLYNSDVKHYRDNFWATADMTLLPGTTTLNDMPSTNTKNDKSFVGGTKLNNKYASIGMDFENQDKTLTAKKSYFILNDKIVFIGTGIKSTVSSKNPVTTVENRKAKGYKLYKDDTQTTNSNNQETNSVFLESDDTKKNIGYHFLDKPIITVKKETHTGKWKDINNSQSTTQKNDDYYEVTQTHNTSETKYAYVLYPGLSKSDFKSKNNNVSIVKQDEDFHVIKDNDGVFAGINYSDSTKTFDINGTKVEVKAKGMFILKKKDDKTYECSFYNPESTNTASDIDSKISMTGYSITNKNTSTSNESGVRFELTK

SEQ ID NO: 39838 - protein, 327 aa, Staphylococcus aureus; identical to SEQ ID NO: 33526
  subsp. aureus LGA251

SEQ ID NO: 39839 - protein, 311 aa, Staphylococcus aureus
  subsp. aureus LGA251
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPSGSAREYFVPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 39840 - protein, 580 aa, Staphylococcus aureus
  subsp. aureus LGA251
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGAKRVIDLKAGIYTADLINTSEIKAININVDTKKQVEDKKKDKANYQVPYTITVNGTSQNILSNLTFNKNQNISYKDLEGKVKSVLESNRGISDIDLRLSKQAKYTVNFKNGTKKVIDLKAGIYTANLINSSDIKSININVDTKKHVENKAKRNYQVPYSINLNGTSTNILSNLSFSNKPWKNYKDLTSQIKSVLKHDRGISEQDLKYAKKAYYTVYFKNGGKRILQLNSKNYTANLVHAKDVKRIEITVKTGPKAKADRYVPYTIAVNGTSTPILSKLKLSQKELISYKYLNDKVKSVLKSERGISDLDLKFAKQAKYTVHFKNGKKQVVNLKSEIFTPNLFSAKDIKKIDIDVKQHTKSKKKINKSNNVKFPVTINKFENLVSNEFVFYNASKITINDLSIKLKSAMANDQGITKHDIGLAERAVYKVYFKNGSSKYVDLKTEYKDGKVFKATDIKKVDIELKF

SEQ ID NO: 39841 - protein, 331 aa, Staphylococcus aureus; identical to SEQ ID NO: 33420
  subsp. aureus LGA251

SEQ ID NO: 39842 - protein, 337 aa, Staphylococcus aureus
  subsp. aureus LGA251
MIKQLYKNITICSLAISTALTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHDVKFVKVLNDNEKK

SEQ ID NO: 39843 - protein, 231 aa, Staphylococcus aureus; identical to SEQ ID NO: 30654
  subsp. aureus LGA251

SEQ ID NO: 39844 - protein, 2483 aa, Staphylococcus aureus
  subsp. aureus LGA251
MNLFRQQKFSIRKFNVGIFSALIATVTFISTNPTTASAAEQNQPAQNQPAQPADANTQPNANAGAQANPTAQPAAPANQGQPAAQPAAQPANQGGQANPAGGAAQPNTQPAGQGNQADPNNAAQAQPGNQAAPANQAGQGNNQATPANQTQPANAPAVAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKVDQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADNILNEDANHVETANRASQADIDGLVTKLQAALIDNQAAIAELDAKAQEKVTAAQQSKKVTQDEVAALVTKINNDKNNAIAEINKQTTAQGVTTEKDNGIAVLDQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNTTNEEVAEADAAVEAAQKQGLHDILVVKSKQEVAETKSKVLDKINAIQTHAKVKPAADTEVENAYNTRKQEIQNSNASTTEEKQAAYTELDTKKQEARTNLDAANSNSEVATAKDNGITAINQVQAATTKKSDAKAEIAQKASERKTAIEAMNDSTTEEQQAAKDKVDQAVVTANTDIDNAAANTDVDNAKTTNEATIAAITPDANVKPTAKQAIADKVQAQETAIDANNGATTEEKATAKQQVQTEKTTADTAIDGAHSNAEVEAAKNAEIAKIEAIQPATTTKDDAKQAITTKANERKTAIAQTQDITAEEIAAANANVDNAVTQANSNIEAANSQNDVEQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQVAQTSVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADVQGITADTTIKDVAKDELATKAKEQKALIAQTADATTEEKEQANQQVDAELTQGNQNIENAQSIDDVNTAKDNAIQAIDPILASTDVKTNARAELLTEMQNKITEILSDNTTTNEEKGKDIEPVRATYEEGLNNINTANTTGDVTTAKDTAVQKVQQLHANPVKKPAGKSALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNGDVDDALTQGKAAIDAIQVDATVKPKANQVIDAKAEETKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIRGVVNKQIEIIKNADADASAKEIARTDLGRYFDRFADKLDKTQTNTEVAELQNVTIPAIEAIVPQNDPNANDTNSGSDNNDATANSNANATPENTGQPNVTESTDNANADTSSTTTNNQNDAATGETTATSANSSAIDDANDKPQANNNSSADASTNSPTMDNDVTSKPEVESTNNGTTDKPATETDNATPAESTTNNNSTTTATNENAPTESTATAPTTASTEAASSADSKDNASVNDSKQNAEVNNSAESQSTNGMVVQPKSENKAKAEKDGRDSTNQSMVESTTETLPSADITEPKVSSNTSKDKEGSTTNQTDAEQLKSETNVASNEADKSEGNIDTDVSNKPSTSKPSEAKDKATSTEDSQKADMATADTKDNQAAIGATADVNNKATQNDGANASPATVSKGSNSANQDMLKVTNTDKHQAKATSAQQGKVNRPKQQAKTLPDTGMSHNDDLPYAELALGAGMAFLIRRFTKKNQQTEE

SEQ ID NO: 39845 - protein, 810 aa, Staphylococcus aureus
  subsp. aureus LGA251
MTYKMKKWQKLSTITLLMAGVITLNGGEFRSIDKHQIAVADTNVQTPDYEKLRNTWLDVNYGYDKYDESNPDMKKKFEATEKEARKLLSSMKTESDRKYLWESSKDLDTKSADMTRTYRNIEKIAEAMKHKNTKLNTPDNKNKVKDALEWLHKNAYGKEPVKKLEELKTNFSKSAPQKNTNLNWWDYEIGTPRALTNTLILLNDQFSNEEKKKYTAPIKTFAPDSDKILSSVGQPEQAKGGNLVDIAKVKLLESIIEEDKDMTKNSIDSFNKVFTYVQSNATGKERNGFYKDGSYIDHQDVPYTGAYGVVLLEGISQMMPMIKATPFKDSNQNDTTLKSWIDDGFMPLIYKGEMMDLSRGRAISRENETSHSASATVMKSLLRLSDAMDDSTKDKYKQIVKTSVESDSSYGQNDTLSSYSDIDKMKALMEDSTLSTNDLTQQLKIYNDMDRVTYHNKDLDFALGLSMTSKNVARYESINNENLKGWHTGAGMSYLYNSDVKHYRDNFWATADMKRLAGTTTLDNEILKDTDDKKSSKTFVGGTKFDDQHASIGMDFENQDKTLTAKKSYFILNDKIVFLGTGIKSTNPSKNPVTTVENRKANGYTLYTDDKQTTASNINDQETNSVFLESTDAKKNIGYHFLNKPKITVKKESHTGKWSDINKSQKTEDKTDEYYEVTQKHSNTDDKYAYVLYPGLSKDVFKTKKDEVTVVKQEDDFHVVKDNESVWAGVNYSNSTQTFDINNTKVEVKAKGMFILKKKDDNTYECSFYNPESTNSVSDIESKISMTGYSITNKNTSTTNESSVRFELTK

SEQ ID NO: 39846 - protein, 141 aa, Staphylococcus aureus; identical to SEQ ID NO: 30633
  subsp. aureus LGA251

SEQ ID NO: 39847 - protein, 691 aa, Staphylococcus aureus; identical to SEQ ID NO: 39194
  subsp. aureus M013

SEQ ID NO: 39848 - protein, 174 aa, Staphylococcus aureus
  subsp. aureus M013
MFLNDAWKKDFKVEFENEALSNEFINKNIDIYTGSYSYECHGGATNKTQCSYGGVTLSDNNKYDDYKNIPCNLWIDGHQTEKELTAVKTKKKIVTIQELDVQLRNYLNEKYKLYEKGGDIVKGYVKYHNDDEKNVEYDFYNLNGEYGHEVLKMYADNKTINSDKLHLDIYLFKS

SEQ ID NO: 39849 - protein, 203 aa, Staphylococcus aureus; identical to SEQ ID NO: 39173
  subsp. aureus M013

SEQ ID NO: 39850 - protein, 226 aa, Staphylococcus aureus; identical to SEQ ID NO: 39174
  subsp. aureus M013

SEQ ID NO: 39851 - protein, 231 aa, Staphylococcus aureus; identical to SEQ ID NO: 39215
  subsp. aureus M013

SEQ ID NO: 39852 - protein, 356 aa, Staphylococcus aureus; identical to SEQ ID NO: 39216
  subsp. aureus M013

SEQ ID NO: 39853 - protein, 347 aa, Staphylococcus aureus
  subsp. aureus M013
MKITTIAKTSLALGLLTTGVITTTTQAANATTPSSIKVETPQPTPNATTPPSTKVETPQQAANATTPSSTKVETPQQAANATTPSSTKVETPQQAANATTPSSTKVEAPKQTPNATTPSSTKVETSQPTPNAPTPPSTKVETPQSPTTKQVPTEINPKFKDLRAYYTKPSLEFKNEIGIILKKWTTIRFMNIVPDYFIYKIALVGKDDKKYGEGVHRNVDVFVVLEENNYNLEKYSVGGITKSNSKKVDHKAGVRITKEDKKGTISHDVSEFKITKEQISLKELDFKLRKQLVENHNLYGNVGSGKIIIKMKNGGKYTFELHKKLQKDRMADVIDGTNIDSIEVNIK

SEQ ID NO: 39854 - protein, 234 aa, Staphylococcus aureus; identical to SEQ ID NO: 39218
  subsp. aureus M013

SEQ ID NO: 39855 - protein, 231 aa, Staphylococcus aureus; identical to SEQ ID NO: 39219
  subsp. aureus M013

SEQ ID NO: 39856 - protein, 232 aa, Staphylococcus aureus; identical to SEQ ID NO: 39220
  subsp. aureus M013

SEQ ID NO: 39857 - protein, 232 aa, Staphylococcus aureus; identical to SEQ ID NO: 39221
  subsp. aureus M013

SEQ ID NO: 39858 - protein, 227 aa, Staphylococcus aureus; identical to SEQ ID NO: 39222
  subsp. aureus M013

SEQ ID NO: 39859 - protein, 233 aa, Staphylococcus aureus; identical to SEQ ID NO: 39223
  subsp. aureus M013

SEQ ID NO: 39860 - protein, 291 aa, Staphylococcus aureus
  subsp. aureus M013
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSYTKYKSLEKDYTLKTAKELQRTLEKEGATVKMTRTDDTYVSLENRDIKGDAYLSIHNDALESSNANGMTVYWYHDNQRVLADTLDATIQKKGLLSNRGSRQENYQVLRQTKVPAVLLELGYISNPTDETMIKDQLHRQILEQAIVDGLKIYFSA

SEQ ID NO: 39861 - protein, 895 aa, Staphylococcus aureus; identical to SEQ ID NO: 39191
  subsp. aureus M013

SEQ ID NO: 39862 - protein, 2185 aa, Staphylococcus aureus
  subsp. aureus M013
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNNDVVSNNTTLNVPNKTNENGSGGHLTLKEIQEDVRHSSDKPELVAIAEQASNRPKKRSRRAAPADPNATPADPAAAAANGTASAGNTATYTPTTDPNGNNVGQNAPNEVLSFDDNSIRPSTNRSVPSVTVVDNLPGFTLINGGKVGVLSHAMVRTNMFQAGSNRTYQAQGNVLALGRISGTDTSNHGDFNGIEKSLTVNPNSELIFEFNTMPTKNGQGATNVIIKNGATNDTIAEKTIEDGPTLRLFKVPDNVNSLKIQFVPKNDAITDANGIYQLKDGYKYYSFVDSIGLHSGSHVYVERRTMEPTATNNKEFTVTTSLKNNGNSGASFDTDEFVYKIQLPEGVEYVNNSLTKDFPSSNSGVDMNDFNVTYDAANRVITIKSTGGGTANSPARLMPDKILDLKYKLRVNNVPTPRKVTFNDTLTYKTYTQDFINSPAESHTVSTNPYTIDIIMNKDALQGEVDRRIQQADYTFASLDIFNALKRRAQTILDENRNNVPLDQRVSQADIDTLTNQMQHTLIRSVDAENAVNQKADQMQDLINQNDELTDEEKQAANQIIEEHKGNIIGDIGDQTTGDGVTRIKDQGIQTLSGDTATPVVKPNAKKAIRDKAAKQREIINNTPDATQDEIQDALNQLTTDETDAIDNVTNATTNDDVETAKNNGINTIGAVVPQVTHKQAARDAINQATATKRQQINNNREATQEEKNAALNELTQATNHALEQINQATTNADVDNAKGDGLNAINPIAPVTVVKQAARDAVSHDVQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAIDRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPSALAQINQHYNAKLAEINATPDATNDEKNAAINTLNQDRQQAIESIKQANTNAEVDQATTVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVASQALAKEKEKALAAIDQAQMNSQVNQAATNGVSAIKIIQPETKVKPAAREKINQKANELRAKINQDKEATAEERQAALDKINEFVNQAMTDITNNRTNQQVDDTTSQALDSIALVTPEHIVRAGARDAVKQQYEAKKQEIEQAEHATDEEKQVALNQLANNEKLALQNINQAVTNNDVKRVETNGIATLKGVQPRIVIKPEAQQAIKASAENQVELIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPSARQSVGIKAEAQNALIDQSDLSTEEERLAAKHLVEQALNQAIDQINHADKTAQVNQDSINTQNIISKIKPATTVKATALQQIQNIATNKINLIKANNEATDEEQNAAIAQVEKELIKAKQQIASAVTNADVAYLLHDEKNEIREIEPVINRKASAREQLTTLFNDKKQAIEANIQATVEERNSILAQLQNIYDTAIGQIDQDRSNTQVDKTASLNLQTIHDLDVHPIKKPDAEKTINDDLARVTDLVQNYRKVSDRNKADALKAITALKLQMDEELKTARTNADVDAVLKRFNVALGDIEAVITEKENSLLRIDNIAQQTYAKFKAIATPEQLAKVKVLIDQYVADGNIMIDEDATLNDIKQHTQFIVDEILAIKLPAEATKVSPKVIQSAPKVCTPIKKEATHKPRKVDKELPNTGSEGMDLPLKEFALITGAALLARRRTKNEKES

SEQ ID NO: 39863 - protein, 331 aa, Staphylococcus aureus; identical to SEQ ID NO: 39228
  subsp. aureus M013

SEQ ID NO: 39864 - protein, 942 aa, Staphylococcus aureus
  subsp. aureus M013
MNNKKTATNRKGMIPNRLNKFSIRKYSVGTASILVGTTLIFGLSGHEAKAAERTNGELNQSKNETTAPSENKTTEKVDSHQQNNIEQSTTSNQPKVNESDNTSVKETTEEPQNTTSTQPTKQNNDATANKDNLAAQNISTQAKDVSATPKTTTIKPRTLNRMAVNTVAAPQQGTNVNDKVHFSNIDIAIDKGHVNKDTGKTEFWATSSDVLKLKANYTIDDSVKEGDTFTFKYGQYFRPGSVRLPSQTQNLYNAQGNIIAKGIYDSNTNTTTYTFTNYVDQYTNVSGSIEQVAFAKRENATTDKTAYKMEVTLGNDKYSKDVIVDYGNKKAQPLISSTNYINNEDLSRNMTAYVNQPKNTYTKQTFVTNLTGYKFNPNAKNFKIYEVTNQNQFVDSFTPDTSKLTDVTNQFNITYSNDNKTASVDLMNGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDADSDSDAGKHTPVKPMSATKDHHNKAKALPETGSENNGSNNATLFGGLFAALGSLLLFGRRKKQNK

SEQ ID NO: 39865 - protein, 1348 aa, Staphylococcus aureus
  subsp. aureus M013
MLNRENKTAMTRKGMVSNRLNKFSIRKYTVGTASILVGTTLIFGLGNQEAKAAEVTNKEMKEDATSVNNDQVSKKVDTEQLNNGGNTSKVDTEQLKDENINKVANQKEVTRVENSVASEKNNNSKPSENGKLQTSDVKKTEDNNATSDDQVTTTVNSQQLNTDNTTSNETMSSAPINVSKDNLKINSEVVKNVVENSDNTDNANGSDVIMPKSTAPKRLNTRMRIAAVQPSSTDSKNVNNLITSTTTLTVVDADNSKTIVPAQDYLSLKSQITVDDKVKSGDYFTIKYSDTVQVYGLNPEDIKNIGDIKDPNNGETIATAKHDTVNNLITYTFTDYVDRFNSVKMGINYSVYMDADTIPVDKKDVPFSVTIGNQTTTTTADITYPAYKEADNNSIGSAFTETVSHAGNAEDPGYYNQVVYVNPMDKDLKGANLKVEAYHPKYPTNIGQINQNVTNIKIYRVPEGYTLNKGYDVNANDLVDVTDEFKNKMTYGSNQSVNVDFGDITSAYVVMVNTKFQYTNSESPTLVQMATLSSTGNKSVSTGNALGFTNNQSAGAGQEVYKIGNYVWEDTNKNGIQELGEVGVKGVTVVAYDNKTNKEVGRTITDEKGGYLIPNLPNGDYRVEFSNLPQGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSSEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSNAGKHTPAKPMSEVKDHHNKAKALPETGSENNNSNNGTLFGGLFAALGSLLLFGRRKKQNK

SEQ ID NO: 39866 - protein, 1125 aa, Staphylococcus aureus
  subsp. aureus M013
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKEESTTSSTQQQQNNVTATTETKPQNIEKENVKPSTDKTATEDTSVILEEKKAPNNTNNDVTTKPSTSETQTKPTTPQESTNIENSQPQPTPSEVDNQVTDATNPKEPVNVSKEELKNNLEKLKELVRNDSNTDRSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETNQNVTVDYQDPMVHGDSNIQSIFTKLDEDKQTIEQQIYVNPLKKTATNTKVDIAGSQVDDYGNIKLGNGSTIIDQNTEIKVYKVNSNQQLPQSNRIYDFSQYEDVTSQFDNKKSFSNNVATLDFGNIDSAYIIKVVSKYTPTSDGELDIAQGTSMRTTDNYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 39867 - protein, 361 aa, Staphylococcus aureus; identical to SEQ ID NO: 39229
  subsp. aureus M013

SEQ ID NO: 39868 - protein, 578 aa, Staphylococcus aureus
  subsp. aureus M013
MKFKSLITTTLALGVLASTGANFNNNEASAGAKPLDKSSSSLHHGYSKVHVPYAITVNGTSQNILSSLTFNKNQNISYKDLEDRVKSVLKSDRGISDIDLRLSKQAEYTVYFKNGAKRVIDLKAGIYTADLINTSEIKAININVDTKKHIEDKKKDKANYQVPYTITVNGTSQNILSNLTFNKNQNISYKDLEDKVKSVLESNRGITDVDLRLSKQAKYTVNFKNGTKKVIDLKAGIYTANLINSSDIKSININVDTKKHVENKAKRNYQVPYSINLNGTSTNILSNLSFSNKPWKNYKDLTRQIKSVLKHDRGISEQDLKYAKKAYYTVYFKNGGKRILQLNSKNYTANLVHAKDVKRIEITVKTGPKAKADRYVPYTIAVNGTSTPILSKLKFSGDPRVGYSDITKKVKSVLKYDRGISDRELKFAKKATYTLHFKNGKKQVVNLNSNIFTPNLFSAKDIKKIDINVKQHTKSKKNKSNNVKFPVTINKFENIVSNEFVFYNASKITINDLSIKLKSAMANDQGITKHDIGLAERAVYKVYFKNGSSKYVDLKTEYKDGKVFKATDIKKVDIELKF

SEQ ID NO: 39869 - protein, 331 aa, Staphylococcus aureus; identical to SEQ ID NO: 33420
  subsp. aureus M013

SEQ ID NO: 39870 - protein, 338 aa, Staphylococcus aureus; identical to SEQ ID NO: 39180
  subsp. aureus M013

SEQ ID NO: 39871 - protein, 321 aa, Staphylococcus aureus
  subsp. aureus M013
MKNKKRVLIASSLSCAILLLSAATTQANSAHKDSQDQNKKEHVDKSQQKDKRNVTNKDKNSPVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKIKMVKD

SEQ ID NO: 39872 - protein, 44 aa, Staphylococcus aureus; identical to SEQ ID NO: 30451
  subsp. aureus M013

SEQ ID NO: 39873 - protein, 231 aa, Staphylococcus aureus
  subsp. aureus M013
MKKTLLASSLAVGLGIVAGNAGHEAHASEADLNKASLAQMAQSNDQTLNQKPIEAGAYNYTFDYEGFTYHFESDGTHFAWNYHATGANGADMSAQAPATNNVAPSAGQANQVQSQEVEASQNAQTQQPQASTSNNSQVTATPTESKASEGSSVIVNDHLKQIAQRESGGNIHAVNPTSGAAGKYQFLQSTWDSVAPAKYKGVSPANAPESVQDAAAVKLYNTGGAGHWVTA

SEQ ID NO: 39874 - protein, 434 aa, Staphylococcus aureus [sequence omitted]

SEQ ID NO: 39875 - protein, 938 aa, Staphylococcus aureus
  subsp. aureus M013
MLVGTLIGFGLLSSKEADASENSVTQSDSASNESKSNDSSSVNAAPKTDNTNVSDTKTTSNTNNGETSVAQYLAQQETTQSVSTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDNDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFPTDDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSDSDSDSDSDSASDSDSASDSDSASDSTSDSDSDSASDSDSASDSDSASDSDSDSDSDSDNDSDSDSDSDSDSDSDSESDSDSDSDSDSDSDSDSDSDSDSDSDSDSDSDSDSDSDLDSDSDSDSDSDSDSDSDSDSDSDSDSDSDSDSDSDSDSDSDSDSDSDSDSDSDSDSDSDSDSASDSDSDSDSDSDSDSDSDSDSESDSDSDSVSDSDSDSDSDSDSNSESDSDSDSDSDSDSASDSDSGSDSDSDSDSDSDSDSDSDSDSDSTSDSDSDSTSDTGSDNDSDSESDSNSDSDSGSNNNVVPPNSPKNGTNASNKNEAKDSKEPLPDTGSEGEENTSLIWGLLASLGSLLLFRRKKENKDKK

SEQ ID NO: 39876 - protein, 242 aa, Staphylococcus aureus; identical to SEQ ID NO: 39198
  subsp. aureus M013

SEQ ID NO: 39877 - protein, 242 aa, Staphylococcus aureus
  subsp. aureus M013
MNKIFRILTVSLFFFTFLIKNNLAYADVGVINLRNFYANYEPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYQSKFNSGFNKGKITFHLNNEPSFTYDLFYTGTGQAESFLKIYNDNKTIDTENFHLDVEISYEKTE

SEQ ID NO: 39878 - protein, 266 aa, Staphylococcus aureus; identical to SEQ ID NO: 30401
  subsp. aureus M013

SEQ ID NO: 39879 - protein, 807 aa, Staphylococcus aureus; identical to SEQ ID NO: 39200
  subsp. aureus M013

SEQ ID NO: 39880 - protein, 641 aa, Staphylococcus aureus; identical to SEQ ID NO: 39176
  subsp. aureus M013

SEQ ID NO: 39881 - protein, 354 aa, Staphylococcus aureus; identical to SEQ ID NO: 39175
  subsp. aureus M013

SEQ ID NO: 39882 - protein, 321 aa, Staphylococcus aureus; identical to SEQ ID NO: 30959
  subsp. aureus M013

SEQ ID NO: 39883 - protein, 315 aa, Staphylococcus aureus; identical to SEQ ID NO: 39208
  subsp. aureus M013

SEQ ID NO: 39884 - protein, 325 aa, Staphylococcus aureus; identical to SEQ ID NO: 30407
  subsp. aureus M013

SEQ ID NO: 39885 - protein, 109 aa, Staphylococcus aureus; identical to SEQ ID NO: 33345
  subsp. aureus M013

SEQ ID NO: 39886 - protein, 165 aa, Staphylococcus aureus; identical to SEQ ID NO: 39213
  subsp. aureus M013

SEQ ID NO: 39887 - protein, 319 aa, Staphylococcus aureus; identical to SEQ ID NO: 30495
  subsp. aureus M013

SEQ ID NO: 39888 - protein, 238 aa, Staphylococcus aureus; identical to SEQ ID NO: 34649
  subsp. aureus M013

SEQ ID NO: 39889 - protein, 241 aa, Staphylococcus aureus; identical to SEQ ID NO: 34650
  subsp. aureus M013

SEQ ID NO: 39890 - protein, 241 aa, Staphylococcus aureus; identical to SEQ ID NO: 34651
  subsp. aureus M013

SEQ ID NO: 39891 - protein, 324 aa, Staphylococcus aureus
  subsp. aureus M013
MIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPEKPEKPSRPTHPSGPVNPDNPGLSKDRAKPNDPVHSMDKNDKVKKSKIAKESVANQEKKRAELPKTGVESTQKGLIFSSIIGIAGLILLARRRKN

SEQ ID NO: 39892 - protein, 724 aa, Staphylococcus aureus
  subsp. aureus M013
MRDKKGPVNKRVDFLSNKLNKYSIRKFTVGTASILIGSLMYLGTQQEAEAAENNIENPTTLKDNVQSKEVKIEEVTNKDTAPQGIEAKSEVTSNKDTIEHEPSVKAEDISKKEDTPKEVANVAEVQPKSSVTHNAETPKVRKARSVDEGSFDITRDSKNVVESTPITIQGKEHFEGYGSVDIQSNPEDLKVSEVTRFNNKSIGRNELTGALQLKNKVSFKNDFEFNIRIANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFEAKREFNPKLQPGEERVNKKDNQEVRQSQHQSQ

SEQ ID NO: 39893 - protein, 931 aa, Staphylococcus aureus; identical to SEQ ID NO: 39202
  subsp. aureus M013

SEQ ID NO: 39894 - protein, 676 aa, Staphylococcus aureus
  subsp. aureus M013
MLTQGSNENGTQPNVKIYEYVGTENGLPQSVYANTVDSTQLKDVTNQMSDKLKVQNNGSYSLNFDKLDKTYVIHYTGDYLNGTSEVNFRTQLTGYPENHYKTYYYYNHGYTLTWDNGLVLYSNKANGDGKYGPIVDSNNFEFSEDSGNGSISGQYDEKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVTDHTTVEDTKEYTTESNLIELVDELPEEHGQAQGPIEEITENNHHISHSGLGTENGHGNYGVVEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHNEIIEEDTNKDKPNYQFGGHNSVDFEEDTLPKVSGQNEGQQTIEEDTTPPTPPTPEVPSEPETPTPPTPEVPSEPETPTPPTPEVPSEPETPTPPTPEVPSEPETPTPPTPEVPSEPETPTPPTPEVPSEPGTPVPPTPEVPAEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 39895 - protein, 361 aa, Staphylococcus aureus
  subsp. aureus M013
MKNNLRYGIRKHKLGAASVFLGTMIVVGMGQDKEAAASEQKTTTVEENGNSATDNKVSETQTTATNVNHIEETQSYNATVTEQPSNATQVTTQEVPKAVQAPLTAQPANVETVKEEVVKEEAKPQVKETTQPQDNSGDQRQVDLTPKKATQNQAAETQVEVAQPRTASESKPRVTRSADVVDASDAKVETGTDVTSKVTVEDESKIEAPKGNNVQPHEGQRVVLKYKLKFQDGLKTGDYFDFTLSNNVNTHGVSTTRKVPDIKNGSLVMAKGQVLDNGRIRYTFIDYIKDKVNVTANLEINLFIDPKTVQSNGQQTITSKLNGKETSGTMQITYKDGVKNHYTNVNGSIETFDKEKINLHT

SEQ ID NO: 39896 - protein, 221 aa, Staphylococcus aureus; identical to SEQ ID NO: 39226
  subsp. aureus M013

SEQ ID NO: 39897 - protein, 233 aa, Staphylococcus aureus; identical to SEQ ID NO: 30678
  subsp. aureus M013

SEQ ID NO: 39898 - protein, 109 aa, Staphylococcus aureus
  subsp. aureus M013
MQQNHLIDGTKDPNVINQLKNANGTTNNSAVNPSIKANDIHTKSNKQMAKQQSIHLDSKSKSVHKQQLKELPKTGVNNESNTAIMALFIGLILLVVSLVTRFIKLNSYQ

SEQ ID NO: 39899 - protein, 949 aa, Staphylococcus aureus; identical to SEQ ID NO: 39230
  subsp. aureus M013

SEQ ID NO: 39900 - protein, 2266 aa, Staphylococcus aureus; identical to SEQ ID NO: 39231
  subsp. aureus M013

SEQ ID NO: 39901 - protein, 681 aa, Staphylococcus aureus
  subsp. aureus M013
MMKSQNKYSIRKFSVGTSSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRTKEAPPLNKSDQTSQRKIVNKTEIEKVQPQQNNQANAKITKHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 39902 - protein, 484 aa, Staphylococcus aureus
  subsp. aureus M013
MKKKNIYSIRKLGVGIASVTLGTLLISGGVTPAANAAKHDEAQQNAFYQVLNMPNLNADQRNGFIQSLKDDPSQSANVLGEAKKLNDSQAPKADAQQNNFNKDQQSAFYEILNMPNLNEAQRNGFIQSLKDDPSQSTNVLGEAKKLNESQASKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNNKPGKEDGNKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 39903 - protein, 325 aa, Staphylococcus aureus; identical to SEQ ID NO: 30484
  subsp. aureus M013

SEQ ID NO: 39904 - protein, 312 aa, Staphylococcus aureus; identical to SEQ ID NO: 30391
  subsp. aureus M013

SEQ ID NO: 39905 - protein, 708 aa, Staphylococcus aureus; identical to SEQ ID NO: 36229
  subsp. aureus M1015

SEQ ID NO: 39906 - protein, 51 aa, Staphylococcus aureus; identical to SEQ ID NO: 35980
  subsp. aureus M1015

SEQ ID NO: 39907 - protein, 1356 aa, Staphylococcus aureus; identical to SEQ ID NO: 35778
  subsp. aureus M1015

SEQ ID NO: 39908 - protein, 935 aa, Staphylococcus aureus
  subsp. aureus M1015
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPDEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDT

SEQ ID NO: 39909 - protein, 54 aa, Staphylococcus aureus; identical to SEQ ID NO: 35777
  subsp. aureus M1015

SEQ ID NO: 39910 - protein, 434 aa, Staphylococcus aureus [sequence omitted]

SEQ ID NO: 39911 - protein, 647 aa, Staphylococcus aureus
  subsp. aureus M1015
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSTSDSDSTSDSDSASDSDSDS

SEQ ID NO: 39912 - protein, 328 aa, Staphylococcus aureus
  subsp. aureus M1015
DSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSESDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 39913 - protein, 648 aa, Staphylococcus aureus; identical to SEQ ID NO: 31909
  subsp. aureus M1015

SEQ ID NO: 39914 - protein, 354 aa, Staphylococcus aureus; identical to SEQ ID NO: 30412
  subsp. aureus M1015

SEQ ID NO: 39915 - protein, 105 aa, Staphylococcus aureus; identical to SEQ ID NO: 31168
  subsp. aureus M1015

SEQ ID NO: 39916 - protein, 165 aa, Staphylococcus aureus; identical to SEQ ID NO: 31241
  subsp. aureus M1015

SEQ ID NO: 39917 - protein, 319 aa, Staphylococcus aureus; identical to SEQ ID NO: 33985
  subsp. aureus M1015

SEQ ID NO: 39918 - protein, 238 aa, Staphylococcus aureus; identical to SEQ ID NO: 31240
  subsp. aureus M1015

SEQ ID NO: 39919 - protein, 241 aa, Staphylococcus aureus; identical to SEQ ID NO: 31239
  subsp. aureus M1015

SEQ ID NO: 39920 - protein, 241 aa, Staphylococcus aureus; identical to SEQ ID NO: 31173
  subsp. aureus M1015

SEQ ID NO: 39921 - protein, 176 aa, Staphylococcus aureus; identical to SEQ ID NO: 35732
  subsp. aureus M1015

SEQ ID NO: 39922 - protein, 325 aa, Staphylococcus aureus; identical to SEQ ID NO: 30484
  subsp. aureus M1015

SEQ ID NO: 39923 - protein, 315 aa, Staphylococcus aureus; identical to SEQ ID NO: 35728
  subsp. aureus M1015

SEQ ID NO: 39924 - protein, 151 aa, Staphylococcus aureus; identical to SEQ ID NO: 35733
  subsp. aureus M1015

SEQ ID NO: 39925 - protein, 291 aa, Staphylococcus aureus; identical to SEQ ID NO: 30390
  subsp. aureus M1015

SEQ ID NO: 39926 - protein, 890 aa, Staphylococcus aureus; identical to SEQ ID NO: 35735
  subsp. aureus M1015

SEQ ID NO: 39927 - protein, 2035 aa, Staphylococcus aureus; identical to SEQ ID NO: 35736
  subsp. aureus M1015

SEQ ID NO: 39928 - protein, 331 aa, Staphylococcus aureus; identical to SEQ ID NO: 31235
  subsp. aureus M1015

SEQ ID NO: 39929 - protein, 808 aa, Staphylococcus aureus; identical to SEQ ID NO: 35738
  subsp. aureus M1015

SEQ ID NO: 39930 - protein, 258 aa, Staphylococcus aureus; identical to SEQ ID NO: 30518
  subsp. aureus M1015

SEQ ID NO: 39931 - protein, 251 aa, Staphylococcus aureus; identical to SEQ ID NO: 30505
  subsp. aureus M1015

SEQ ID NO: 39932 - protein, 261 aa, Staphylococcus aureus; identical to SEQ ID NO: 30506
  subsp. aureus M1015

SEQ ID NO: 39933 - protein, 242 aa, Staphylococcus aureus; identical to SEQ ID NO: 30522
  subsp. aureus M1015

SEQ ID NO: 39934 - protein, 239 aa, Staphylococcus aureus; identical to SEQ ID NO: 35743
  subsp. aureus M1015

SEQ ID NO: 39935 - protein, 254 aa, Staphylococcus aureus; identical to SEQ ID NO: 31226
  subsp. aureus M1015

SEQ ID NO: 39936 - protein, 689 aa, Staphylococcus aureus; identical to SEQ ID NO: 31861
  subsp. aureus M1015

SEQ ID NO: 39937 - protein, 274 aa, Staphylococcus aureus; identical to SEQ ID NO: 33993
  subsp. aureus M1015

SEQ ID NO: 39938 - protein, 339 aa, Staphylococcus aureus; identical to SEQ ID NO: 31219
  subsp. aureus M1015

SEQ ID NO: 39939 - protein, 351 aa, Staphylococcus aureus; identical to SEQ ID NO: 33991
  subsp. aureus M1015

SEQ ID NO: 39940 - protein, 231 aa, Staphylococcus aureus; identical to SEQ ID NO: 31216
  subsp. aureus M1015

SEQ ID NO: 39941 - protein, 40 aa, Staphylococcus aureus; identical to SEQ ID NO: 31854
  subsp. aureus M1015

SEQ ID NO: 39942 - protein, 233 aa, Staphylococcus aureus; identical to SEQ ID NO: 31039
  subsp. aureus M1015

SEQ ID NO: 39943 - protein, 257 aa, Staphylococcus aureus
  subsp. aureus M1015
DSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 39944 - protein, 681 aa, Staphylococcus aureus
  subsp. aureus M1015
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSD

SEQ ID NO: 39945 - protein, 91 aa, Staphylococcus aureus; identical to SEQ ID NO: 35761
  subsp. aureus M1015

SEQ ID NO: 39946 - protein, 681 aa, Staphylococcus aureus; identical to SEQ ID NO: 31046
  subsp. aureus M1015

SEQ ID NO: 39947 - protein, 53 aa, Staphylococcus aureus
  subsp. aureus M1015
MDKDDQPKDNKTKPENPLKELPKTGMKIITSWITWVFIGILGLYLILRKRFNS

SEQ ID NO: 39948 - protein, 586 aa, Staphylococcus aureus
  subsp. aureus M1015
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDL

SEQ ID NO: 39949 - protein, 453 aa, Staphylococcus aureus; identical to SEQ ID NO: 35702
  subsp. aureus M1015

SEQ ID NO: 39950 - protein, 221 aa, Staphylococcus aureus; identical to SEQ ID NO: 31036
  subsp. aureus M1015

SEQ ID NO: 39951 - protein, 691 aa, Staphylococcus aureus; identical to SEQ ID NO: 31040
  subsp. aureus M1015

SEQ ID NO: 39952 - protein, 226 aa, Staphylococcus aureus; identical to SEQ ID NO: 31265
  subsp. aureus M1015

SEQ ID NO: 39953 - protein, 231 aa, Staphylococcus aureus; identical to SEQ ID NO: 35706
  subsp. aureus M1015

SEQ ID NO: 39954 - protein, 343 aa, Staphylococcus aureus; identical to SEQ ID NO: 31263
  subsp. aureus M1015

SEQ ID NO: 39955 - protein, 304 aa, Staphylococcus aureus; identical to SEQ ID NO: 35708
  subsp. aureus M1015

SEQ ID NO: 39956 - protein, 234 aa, Staphylococcus aureus; identical to SEQ ID NO: 30567
  subsp. aureus M1015

SEQ ID NO: 39957 - protein, 231 aa, Staphylococcus aureus; identical to SEQ ID NO: 30566
  subsp. aureus M1015

SEQ ID NO: 39958 - protein, 232 aa, Staphylococcus aureus; identical to SEQ ID NO: 30565
  subsp. aureus M1015

SEQ ID NO: 39959 - protein, 227 aa, Staphylococcus aureus; identical to SEQ ID NO: 30564
  subsp. aureus M1015

SEQ ID NO: 39960 - protein, 232 aa, Staphylococcus aureus; identical to SEQ ID NO: 31257
  subsp. aureus M1015

SEQ ID NO: 39961 - protein, 808 aa, Staphylococcus aureus; identical to SEQ ID NO: 31215
  subsp. aureus M1015

SEQ ID NO: 39962 - protein, 141 aa, Staphylococcus aureus; identical to SEQ ID NO: 31214
  subsp. aureus M1015

SEQ ID NO: 39963 - protein, 321 aa, Staphylococcus aureus; identical to SEQ ID NO: 31900
  subsp. aureus M1015

SEQ ID NO: 39964 - protein, 315 aa, Staphylococcus aureus; identical to SEQ ID NO: 31191
  subsp. aureus M1015

SEQ ID NO: 39965 - protein, 325 aa, Staphylococcus aureus; identical to SEQ ID NO: 30479
  subsp. aureus M1015

SEQ ID NO: 39966 - protein, 886 aa, Staphylococcus aureus; identical to SEQ ID NO: 33998
  subsp. aureus M1015

SEQ ID NO: 39967 - protein, 1019 aa, Staphylococcus aureus; identical to SEQ ID NO: 35818
  subsp. aureus M1015

SEQ ID NO: 39968 - protein, 226 aa, Staphylococcus aureus; identical to SEQ ID NO: 31265
  subsp. aureus M809

SEQ ID NO: 39969 - protein, 231 aa, Staphylococcus aureus; identical to SEQ ID NO: 35706
  subsp. aureus M809

SEQ ID NO: 39970 - protein, 343 aa, Staphylococcus aureus; identical to SEQ ID NO: 31263
  subsp. aureus M809

SEQ ID NO: 39971 - protein, 304 aa, Staphylococcus aureus; identical to SEQ ID NO: 35708
  subsp. aureus M809

SEQ ID NO: 39972 - protein, 234 aa, Staphylococcus aureus; identical to SEQ ID NO: 30567
  subsp. aureus M809

SEQ ID NO: 39973 - protein, 231 aa, Staphylococcus aureus; identical to SEQ ID NO: 30566
  subsp. aureus M809

SEQ ID NO: 39974 - protein, 232 aa, Staphylococcus aureus; identical to SEQ ID NO: 30565
  subsp. aureus M809

SEQ ID NO: 39975 - protein, 227 aa, Staphylococcus aureus; identical to SEQ ID NO: 30564
  subsp. aureus M809

SEQ ID NO: 39976 - protein, 232 aa, Staphylococcus aureus; identical to SEQ ID NO: 31257
  subsp. aureus M809

SEQ ID NO: 39977 - protein, 713 aa, Staphylococcus aureus
  subsp. aureus M809
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYDNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDS

SEQ ID NO: 39978 - protein, 159 aa, Staphylococcus aureus
  subsp. aureus M809
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKLMIIMQLQMIKLLLQLIHSN

SEQ ID NO: 39979 - protein, 858 aa, Staphylococcus aureus; identical to SEQ ID NO: 35718
  subsp. aureus M809

SEQ ID NO: 39980 - protein, 434 aa, Staphylococcus aureus [sequence omitted]

SEQ ID NO: 39981 - protein, 725 aa, Staphylococcus aureus
  subsp. aureus M809
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNLNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDS

SEQ ID NO: 39982 - protein, 62 aa, Staphylococcus aureus; identical to SEQ ID NO: 35782
  subsp. aureus M809

SEQ ID NO: 39983 - protein, 648 aa, Staphylococcus aureus; identical to SEQ ID NO: 31909
  subsp. aureus M809

SEQ ID NO: 39984 - protein, 354 aa, Staphylococcus aureus; identical to SEQ ID NO: 30412
  subsp. aureus M809

SEQ ID NO: 39985 - protein, 105 aa, Staphylococcus aureus; identical to SEQ ID NO: 31168
  subsp. aureus M809

SEQ ID NO: 39986 - protein, 165 aa, Staphylococcus aureus; identical to SEQ ID NO: 31241
  subsp. aureus M809

SEQ ID NO: 39987 - protein, 319 aa, Staphylococcus aureus; identical to SEQ ID NO: 33985
  subsp. aureus M809

SEQ ID NO: 39988 - protein, 238 aa, Staphylococcus aureus; identical to SEQ ID NO: 31240
  subsp. aureus M809

SEQ ID NO: 39989 - protein, 225 aa, Staphylococcus aureus; identical to SEQ ID NO: 31903
  subsp. aureus M809

SEQ ID NO: 39990 - protein, 241 aa, Staphylococcus aureus; identical to SEQ ID NO: 31173
  subsp. aureus M809

SEQ ID NO: 39991 - protein, 325 aa, Staphylococcus aureus; identical to SEQ ID NO: 30484
  subsp. aureus M809

SEQ ID NO: 39992 - protein, 315 aa, Staphylococcus aureus; identical to SEQ ID NO: 35728
  subsp. aureus M809

SEQ ID NO: 39993 - protein, 192 aa, Staphylococcus aureus; identical to SEQ ID NO: 35907
  subsp. aureus M809

SEQ ID NO: 39994 - protein, 689 aa, Staphylococcus aureus; identical to SEQ ID NO: 31861
  subsp. aureus M809

SEQ ID NO: 39995 - protein, 151 aa, Staphylococcus aureus
  subsp. aureus M809
MLEGIFTNSASAIEYSDLHHKSKLDSKRLYNAKVSFANPTDLENKKTNDRLLKHDLLFHDMFLNDAWKKDLKVEFENEALSKKFINKNIDVYAGSYSYECHGGETNKTQCSYGGVTLSDNNKYDDYKNIPCNLWIDGHQTEIELTAVKMKK

SEQ ID NO: 39996 - protein, 291 aa, Staphylococcus aureus; identical to SEQ ID NO: 30390
  subsp. aureus M809

SEQ ID NO: 39997 - protein, 890 aa, Staphylococcus aureus; identical to SEQ ID NO: 35735
  subsp. aureus M809

SEQ ID NO: 39998 - protein, 2035 aa, Staphylococcus aureus; identical to SEQ ID NO: 35736
  subsp. aureus M809

SEQ ID NO: 39999 - protein, 331 aa, Staphylococcus aureus; identical to SEQ ID NO: 31235
  subsp. aureus M809

SEQ ID NO: 40000 - protein, 482 aa, Staphylococcus aureus
  subsp. aureus M809
SPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVTNSNDAGVNFELTK

SEQ ID NO: 40001 - protein, 258 aa, Staphylococcus aureus; identical to SEQ ID NO: 30518
  subsp. aureus M809

SEQ ID NO: 40002 - protein, 251 aa, Staphylococcus aureus; identical to SEQ ID NO: 30505
  subsp. aureus M809

SEQ ID NO: 40003 - protein, 261 aa, Staphylococcus aureus; identical to SEQ ID NO: 30506
  subsp. aureus M809

SEQ ID NO: 40004 - protein, 242 aa, Staphylococcus aureus; identical to SEQ ID NO: 30522
  subsp. aureus M809

SEQ ID NO: 40005 - protein, 239 aa, Staphylococcus aureus; identical to SEQ ID NO: 35743
  subsp. aureus M809

SEQ ID NO: 40006 - protein, 254 aa, Staphylococcus aureus; identical to SEQ ID NO: 31226
  subsp. aureus M809

SEQ ID NO: 40007 - protein, 274 aa, Staphylococcus aureus; identical to SEQ ID NO: 33993
  subsp. aureus M809

SEQ ID NO: 40008 - protein, 339 aa, Staphylococcus aureus; identical to SEQ ID NO: 31219
  subsp. aureus M809

SEQ ID NO: 40009 - protein, 351 aa, Staphylococcus aureus; identical to SEQ ID NO: 33991
  subsp. aureus M809

SEQ ID NO: 40010 - protein, 231 aa, Staphylococcus aureus; identical to SEQ ID NO: 31216
  subsp. aureus M809

SEQ ID NO: 40011 - protein, 464 aa, Staphylococcus aureus
  subsp. aureus M809
MPLIYKGEMMDLSRGRAISRENETSHSASATVMKSLLRLSDTMDKSTKAKYKKIVKTSVESDSSYKQTDYLSSYSDISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 40012 - protein, 141 aa, Staphylococcus aureus; identical to SEQ ID NO: 31214
  subsp. aureus M809

SEQ ID NO: 40013 - protein, 321 aa, Staphylococcus aureus; identical to SEQ ID NO: 31900
  subsp. aureus M809

SEQ ID NO: 40014 - protein, 315 aa, Staphylococcus aureus; identical to SEQ ID NO: 31191
  subsp. aureus M809

SEQ ID NO: 40015 - protein, 325 aa, Staphylococcus aureus; identical to SEQ ID NO: 30479
  subsp. aureus M809

SEQ ID NO: 40016 - protein, 185 aa, Staphylococcus aureus
  subsp. aureus M809
MPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 40017 - protein, 712 aa, Staphylococcus aureus
  subsp. aureus M809
MHLKGDIIVKNNLRYGIRKHKLGAASVFLGTMIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGVVSDHTTVEDTKEYTTESNLIELVDELPEEHGQAQGPIEEI

SEQ ID NO: 40018 - protein, 648 aa, Staphylococcus aureus
  subsp. aureus M809
MKSNLRYGIRKHKLGAASVFLGTMIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPVEEI

SEQ ID NO: 40019 - protein, 168 aa, Staphylococcus aureus
  subsp. aureus M809
MPQIHGFNKHNEIIEEDTNKDKPNYQFGGHNSVDFEEDTLPKVSGQNEGQQTIEEDTTPPTPEVPSEPGTPVPPTPEVPAEPGKPVPPAKDEPKKPSKPVEQGKVVTPVIEINEKVKAVAPTKQKQSKKSELPETGGEESTNKGMLFGGLFSILGLALLRRNKKNHKA

SEQ ID NO: 40020 - protein, 681 aa, Staphylococcus aureus; identical to SEQ ID NO: 31046
  subsp. aureus M809

SEQ ID NO: 40021 - protein, 582 aa, Staphylococcus aureus; identical to SEQ ID NO: 35824
  subsp. aureus M809

SEQ ID NO: 40022 - protein, 192 aa, Staphylococcus aureus
  subsp. aureus M809
MSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40023 - protein, 221 aa, Staphylococcus aureus; identical to SEQ ID NO: 31036
  subsp. aureus M809

SEQ ID NO: 40024 - protein, 691 aa, Staphylococcus aureus; identical to SEQ ID NO: 31040
  subsp. aureus M809

SEQ ID NO: 40025 - protein, 233 aa, Staphylococcus aureus; identical to SEQ ID NO: 31039
  subsp. aureus M809

SEQ ID NO: 40026 - protein, 828 aa, Staphylococcus aureus
  subsp. aureus M809
MSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 40027 - protein, 1731 aa, Staphylococcus aureus; identical to SEQ ID NO: 35821
  subsp. aureus M809

SEQ ID NO: 40028 - protein, 691 aa, Staphylococcus aureus; identical to SEQ ID NO: 31040
  subsp. aureus M876

SEQ ID NO: 40029 - protein, 226 aa, Staphylococcus aureus; identical to SEQ ID NO: 31265
  subsp. aureus M876

SEQ ID NO: 40030 - protein, 231 aa, Staphylococcus aureus; identical to SEQ ID NO: 35706
  subsp. aureus M876

SEQ ID NO: 40031 - protein, 343 aa, Staphylococcus aureus; identical to SEQ ID NO: 31263
  subsp. aureus M876

SEQ ID NO: 40032 - protein, 304 aa, Staphylococcus aureus; identical to SEQ ID NO: 35708
  subsp. aureus M876

SEQ ID NO: 40033 - protein, 234 aa, Staphylococcus aureus; identical to SEQ ID NO: 30567
  subsp. aureus M876

SEQ ID NO: 40034 - protein, 231 aa, Staphylococcus aureus; identical to SEQ ID NO: 30566
  subsp. aureus M876

SEQ ID NO: 40035 - protein, 232 aa, Staphylococcus aureus; identical to SEQ ID NO: 30565
  subsp. aureus M876

SEQ ID NO: 40036 - protein, 227 aa, Staphylococcus aureus; identical to SEQ ID NO: 30564
  subsp. aureus M876

SEQ ID NO: 40037 - protein, 232 aa, Staphylococcus aureus; identical to SEQ ID NO: 31257
  subsp. aureus M876

SEQ ID NO: 40038 - protein, 810 aa, Staphylococcus aureus
  subsp. aureus M876
MSMTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSDISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITSKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 40039 - protein, 141 aa, Staphylococcus aureus; identical to SEQ ID NO: 31214
  subsp. aureus M876

SEQ ID NO: 40040 - protein, 321 aa, Staphylococcus aureus; identical to SEQ ID NO: 31900
  subsp. aureus M876

SEQ ID NO: 40041 - protein, 315 aa, Staphylococcus aureus; identical to SEQ ID NO: 31191
  subsp. aureus M876

SEQ ID NO: 40042 - protein, 325 aa, Staphylococcus aureus; identical to SEQ ID NO: 30479
  subsp. aureus M876

SEQ ID NO: 40043 - protein, 909 aa, Staphylococcus aureus
  subsp. aureus M876
MKSNLRYGIRKHKLGAASVFLGTMIVVGMGQEKEAAASEQNNTTVEESGSSATESKASETQTTTNNVNTIDETQSYSATSTEQPSQSTQVTTEEAPTTVQAPKVETEMKLQEDLPSEKVADKKTTGTQVDTAQPSNVSEIKPRMKRSADVAEVAEKEVVGEAKATGTDVTSKVKVTESSLEGHNKDSNIVNPHNAQRVTLKYKWKFGEGIKAGDYFDFTLSDNVETHGISTLRKVPEIKNSTEDKVMAIGEVIAERKIRYTFTDYIDNKKDLTAELSLNLFIDPTTVTKQGKQKVEVTLGDKTIEKEFDIKYLDGVKDRMGVTVNGRIDTLNKADGKFSHFAYVKPNNQSLSSVTVTGQVTSGYKQNANKPTVKVYKHIGSDELAESVYAKLDDVNKFEDVTEKVNLSYTSNGGYTLNLSDLDNSNDYVIKYEGEYDQNAKDLNFRTHLSGYHKNYPYYPYYSYYPVQLTWNNGVAFYSNNAQGDGKDKPNDPIIDKSEPIELDIKSEPPVEKHELTGTIEESNDSKPIDFEYHTAVEGAEGHAEGIVETEEDSIHVDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQSKKSELPETGGEESTNKGMLFGGLFSILGLALLRRNKKNHKA

SEQ ID NO: 40044 - protein, 1019 aa, Staphylococcus aureus; identical to SEQ ID NO: 35818
  subsp. aureus M876

SEQ ID NO: 40045 - protein, 233 aa, Staphylococcus aureus; identical to SEQ ID NO: 31039
  subsp. aureus M876

SEQ ID NO: 40046 - protein, 927 aa, Staphylococcus aureus; identical to SEQ ID NO: 38626
  subsp. aureus M876

SEQ ID NO: 40047 - protein, 1731 aa, Staphylococcus aureus; identical to SEQ ID NO: 35821
  subsp. aureus M876

SEQ ID NO: 40048 - protein, 681 aa, Staphylococcus aureus
  subsp. aureus M876
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPRDVNQGLEQAINDGKQSKVASQQQSKEADNSQDLNANNNLPSQSRTKVSPSLNKSDQTSQREIVNETEIEKVQPQQKNQANDKITDHNFNNEQEVKPQKDEKTLSVSDLKNNQKSPVEPTKDNDKKNGLNLLKSSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGSREEIEYQKKHGGEISPLFKGNNDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFLFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 40049 - protein, 725 aa, Staphylococcus aureus
  subsp. aureus M876
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSIS

SEQ ID NO: 40050 - protein, 454 aa, Staphylococcus aureus; identical to SEQ ID NO: 38631
  subsp. aureus M876

SEQ ID NO: 40051 - protein, 221 aa, Staphylococcus aureus; identical to SEQ ID NO: 31036
  subsp. aureus M876

SEQ ID NO: 40052 - protein, 960 aa, Staphylococcus aureus
  subsp. aureus M876
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYDNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSESDSDSESDSDSDSDSDSDSDSDSDSDSDSESDSDSDSDSDSDSDSDSDSDSDSDSDSDSDSDSDSDSDSDSDSESDSDSDSDSESDSDSDSDSESDSDSDSDSDSDSDSESDSDSDSDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 40053 - protein, 1356 aa, Staphylococcus aureus; identical to SEQ ID NO: 35778
  subsp. aureus M876

SEQ ID NO: 40054 - protein, 1155 aa, Staphylococcus aureus; identical to SEQ ID NO: 36232
  subsp. aureus M876

SEQ ID NO: 40055 - protein, 434 aa, Staphylococcus aureus [sequence omitted]

SEQ ID NO: 40056 - protein, 1005 aa, Staphylococcus aureus; identical to SEQ ID NO: 35721
  subsp. aureus M876

SEQ ID NO: 40057 - protein, 648 aa, Staphylococcus aureus; identical to SEQ ID NO: 31909
  subsp. aureus M876

SEQ ID NO: 40058 - protein, 354 aa, Staphylococcus aureus; identical to SEQ ID NO: 30412
  subsp. aureus M876

SEQ ID NO: 40059 - protein, 105 aa, Staphylococcus aureus; identical to SEQ ID NO: 31168
  subsp. aureus M876

SEQ ID NO: 40060 - protein, 165 aa, Staphylococcus aureus; identical to SEQ ID NO: 31241
  subsp. aureus M876

SEQ ID NO: 40061 - protein, 319 aa, Staphylococcus aureus; identical to SEQ ID NO: 33985
  subsp. aureus M876

SEQ ID NO: 40062 - protein, 238 aa, Staphylococcus aureus; identical to SEQ ID NO: 31240
  subsp. aureus M876

SEQ ID NO: 40063 - protein, 241 aa, Staphylococcus aureus; identical to SEQ ID NO: 31239
  subsp. aureus M876

SEQ ID NO: 40064 - protein, 241 aa, Staphylococcus aureus; identical to SEQ ID NO: 31173
  subsp. aureus M876

SEQ ID NO: 40065 - protein, 176 aa, Staphylococcus aureus; identical to SEQ ID NO: 35732
  subsp. aureus M876

SEQ ID NO: 40066 - protein, 325 aa, Staphylococcus aureus; identical to SEQ ID NO: 30484
  subsp. aureus M876

SEQ ID NO: 40067 - protein, 315 aa, Staphylococcus aureus; identical to SEQ ID NO: 35728
  subsp. aureus M876

SEQ ID NO: 40068 - protein, 151 aa, Staphylococcus aureus; identical to SEQ ID NO: 35733
  subsp. aureus M876

SEQ ID NO: 40069 - protein, 291 aa, Staphylococcus aureus; identical to SEQ ID NO: 30390
  subsp. aureus M876

SEQ ID NO: 40070 - protein, 890 aa, Staphylococcus aureus
  subsp. aureus M876
MNKHHPKLRSFYSIRKSTLGVASVIVSTLFLITSQHQAQAAENTNTSDKISENQNNNATTTQPPKDTNQTQPATQPTNTAKTYPAADESLKDAIKNPAVENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGAETNYDYTKLVFAKPIYNDPSLVKSDTNDAVATNDQSSSDASNQTNTNTSNQNTSTTNNTNDQPQATNNMSQPAQPKASANSEQASSQPAHETNSNDNTNDVTNASSNQSNGNQQYPPADESLQDAIKNPAIIDKEHTADHWRPIDFQMKNDKGERQFYHYASTVEPATVIFTKTGPIIELGLKTASTWKKFEVYEGDKKLPVELVSYDSDKDYAYIRFPVSNGAREVKIVSSIEYGENFHEDYDYTLMVFAQPITNNPDDYVDEETYNLQKLLAPYHKAKTLERQVYELEKLQDKLPEKYKAEYKKKLDQTRVELADQVKSAVTEFENVTPTNDQLTDVQEAHFVVFESEENSESVMDGFVEHPFYTATLNGQKYVVMKTKDDSYWKDLIVEGKRVTTVSKDPKNNSRTLIFPYVPDKAIYNAIVKVVVANIGYEGQYHVRIVNQDIKTKDDDTSQNNTIEPLNVQTGQEDKVTATDTAENSSTATNPKDASDKADVIEPESDVVKDADSSVDKDVQNDVDHLSDMSDNTHLDKYDFKEMDTQIAKDTDKGVDNSLGMTSNVDTDKDSNKNEGKVIQLAHNTDKNHTGKAAKLDGVRQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 40071 - protein, 2035 aa, Staphylococcus aureus; identical to SEQ ID NO: 35736
  subsp. aureus M876

SEQ ID NO: 40072 - protein, 331 aa, Staphylococcus aureus; identical to SEQ ID NO: 31235
  subsp. aureus M876

SEQ ID NO: 40073 - protein, 808 aa, Staphylococcus aureus; identical to SEQ ID NO: 35738
  subsp. aureus M876

SEQ ID NO: 40074 - protein, 258 aa, Staphylococcus aureus; identical to SEQ ID NO: 30518
  subsp. aureus M876

SEQ ID NO: 40075 - protein, 251 aa, Staphylococcus aureus; identical to SEQ ID NO: 30505
  subsp. aureus M876

SEQ ID NO: 40076 - protein, 261 aa, Staphylococcus aureus; identical to SEQ ID NO: 30506
  subsp. aureus M876

SEQ ID NO: 40077 - protein, 242 aa, Staphylococcus aureus; identical to SEQ ID NO: 30522
  subsp. aureus M876

SEQ ID NO: 40078 - protein, 239 aa, Staphylococcus aureus; identical to SEQ ID NO: 35743
  subsp. aureus M876

SEQ ID NO: 40079 - protein, 254 aa, Staphylococcus aureus; identical to SEQ ID NO: 31226
  subsp. aureus M876

SEQ ID NO: 40080 - protein, 689 aa, Staphylococcus aureus; identical to SEQ ID NO: 31861
  subsp. aureus M876

SEQ ID NO: 40081 - protein, 274 aa, Staphylococcus aureus; identical to SEQ ID NO: 33993
  subsp. aureus M876

SEQ ID NO: 40082 - protein, 339 aa, Staphylococcus aureus; identical to SEQ ID NO: 31219
  subsp. aureus M876

SEQ ID NO: 40083 - protein, 351 aa, Staphylococcus aureus; identical to SEQ ID NO: 33991
  subsp. aureus M876

SEQ ID NO: 40084 - protein, 231 aa, Staphylococcus aureus; identical to SEQ ID NO: 31216
  subsp. aureus M876

SEQ ID NO: 40085 - protein, 233 aa, Staphylococcus aureus; identical to SEQ ID NO: 31039
  subsp. aureus M899

SEQ ID NO: 40086 - protein, 828 aa, Staphylococcus aureus; identical to SEQ ID NO: 40026
  subsp. aureus M899

SEQ ID NO: 40087 - protein, 91 aa, Staphylococcus aureus; identical to SEQ ID NO: 35761
  subsp. aureus M899

SEQ ID NO: 40088 - protein, 681 aa, Staphylococcus aureus; identical to SEQ ID NO: 40048
  subsp. aureus M899

SEQ ID NO: 40089 - protein, 88 aa, Staphylococcus aureus; identical to SEQ ID NO: 35700
  subsp. aureus M899

SEQ ID NO: 40090 - protein, 584 aa, Staphylococcus aureus
  subsp. aureus M899
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFK

SEQ ID NO: 40091 - protein, 453 aa, Staphylococcus aureus; identical to SEQ ID NO: 35702
  subsp. aureus M899

SEQ ID NO: 40092 - protein, 221 aa, Staphylococcus aureus; identical to SEQ ID NO: 31036
  subsp. aureus M899

SEQ ID NO: 40093 - protein, 691 aa, Staphylococcus aureus; identical to SEQ ID NO: 31040
  subsp. aureus M899

SEQ ID NO: 40094 - protein, 226 aa, Staphylococcus aureus; identical to SEQ ID NO: 31265
  subsp. aureus M899

SEQ ID NO: 40095 - protein, 231 aa, Staphylococcus aureus; identical to SEQ ID NO: 35706
  subsp. aureus M899

SEQ ID NO: 40096 - protein, 343 aa, Staphylococcus aureus; identical to SEQ ID NO: 31263
  subsp. aureus M899

SEQ ID NO: 40097 - protein, 304 aa, Staphylococcus aureus; identical to SEQ ID NO: 35708
  subsp. aureus M899

SEQ ID NO: 40098 - protein, 234 aa, Staphylococcus aureus; identical to SEQ ID NO: 30567
  subsp. aureus M899

SEQ ID NO: 40099 - protein, 231 aa, Staphylococcus aureus; identical to SEQ ID NO: 30566
  subsp. aureus M899

SEQ ID NO: 40100 - protein, 232 aa, Staphylococcus aureus; identical to SEQ ID NO: 30565
  subsp. aureus M899

SEQ ID NO: 40101 - protein, 227 aa, Staphylococcus aureus; identical to SEQ ID NO: 30564
  subsp. aureus M899

SEQ ID NO: 40102 - protein, 232 aa, Staphylococcus aureus; identical to SEQ ID NO: 31257
  subsp. aureus M899

SEQ ID NO: 40103 - protein, 712 aa, Staphylococcus aureus
  subsp. aureus M899
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYDNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSD

SEQ ID NO: 40104 - protein, 54 aa, Staphylococcus aureus; identical to SEQ ID NO: 35777
  subsp. aureus M899

SEQ ID NO: 40105 - protein, 1356 aa, Staphylococcus aureus; identical to SEQ ID NO: 35778
  subsp. aureus M899

SEQ ID NO: 40106 - protein, 1155 aa, Staphylococcus aureus; identical to SEQ ID NO: 36232
  subsp. aureus M899

SEQ ID NO: 40107 - protein, 434 aa, Staphylococcus aureus [sequence omitted]

SEQ ID NO: 40108 - protein, 1005 aa, Staphylococcus aureus; identical to SEQ ID NO: 35721
  subsp. aureus M899

SEQ ID NO: 40109 - protein, 648 aa, Staphylococcus aureus; identical to SEQ ID NO: 31909
  subsp. aureus M899

SEQ ID NO: 40110 - protein, 354 aa, Staphylococcus aureus; identical to SEQ ID NO: 30412
  subsp. aureus M899

SEQ ID NO: 40111 - protein, 105 aa, Staphylococcus aureus; identical to SEQ ID NO: 31168
  subsp. aureus M899

SEQ ID NO: 40112 - protein, 165 aa, Staphylococcus aureus; identical to SEQ ID NO: 31241
  subsp. aureus M899

SEQ ID NO: 40113 - protein, 319 aa, Staphylococcus aureus; identical to SEQ ID NO: 33985
  subsp. aureus M899

SEQ ID NO: 40114 - protein, 238 aa, Staphylococcus aureus; identical to SEQ ID NO: 31240
  subsp. aureus M899

SEQ ID NO: 40115 - protein, 241 aa, Staphylococcus aureus; identical to SEQ ID NO: 31239
  subsp. aureus M899

SEQ ID NO: 40116 - protein, 241 aa, Staphylococcus aureus; identical to SEQ ID NO: 31173
  subsp. aureus M899

SEQ ID NO: 40117 - protein, 176 aa, Staphylococcus aureus; identical to SEQ ID NO: 35732
  subsp. aureus M899

SEQ ID NO: 40118 - protein, 325 aa, Staphylococcus aureus; identical to SEQ ID NO: 30484
  subsp. aureus M899

SEQ ID NO: 40119 - protein, 315 aa, Staphylococcus aureus; identical to SEQ ID NO: 35728
  subsp. aureus M899

SEQ ID NO: 40120 - protein, 151 aa, Staphylococcus aureus; identical to SEQ ID NO: 35733
  subsp. aureus M899

SEQ ID NO: 40121 - protein, 422 aa, Staphylococcus aureus; identical to SEQ ID NO: 35994
  subsp. aureus M899

SEQ ID NO: 40122 - protein, 291 aa, Staphylococcus aureus; identical to SEQ ID NO: 30390
  subsp. aureus M899

SEQ ID NO: 40123 - protein, 890 aa, Staphylococcus aureus; identical to SEQ ID NO: 40070
  subsp. aureus M899

SEQ ID NO: 40124 - protein, 2035 aa, Staphylococcus aureus; identical to SEQ ID NO: 35736
  subsp. aureus M899

SEQ ID NO: 40125 - protein, 331 aa, Staphylococcus aureus; identical to SEQ ID NO: 31235
  subsp. aureus M899

SEQ ID NO: 40126 - protein, 808 aa, Staphylococcus aureus; identical to SEQ ID NO: 35738
  subsp. aureus M899

SEQ ID NO: 40127 - protein, 258 aa, Staphylococcus aureus; identical to SEQ ID NO: 30518
  subsp. aureus M899

SEQ ID NO: 40128 - protein, 251 aa, Staphylococcus aureus; identical to SEQ ID NO: 30505
  subsp. aureus M899

SEQ ID NO: 40129 - protein, 261 aa, Staphylococcus aureus; identical to SEQ ID NO: 30506
  subsp. aureus M899

SEQ ID NO: 40130 - protein, 242 aa, Staphylococcus aureus; identical to SEQ ID NO: 30522
  subsp. aureus M899

SEQ ID NO: 40131 - protein, 239 aa, Staphylococcus aureus; identical to SEQ ID NO: 35743
  subsp. aureus M899

SEQ ID NO: 40132 - protein, 254 aa, Staphylococcus aureus; identical to SEQ ID NO: 31226
  subsp. aureus M899

SEQ ID NO: 40133 - protein, 689 aa, Staphylococcus aureus; identical to SEQ ID NO: 31861
  subsp. aureus M899

SEQ ID NO: 40134 - protein, 274 aa, Staphylococcus aureus; identical to SEQ ID NO: 33993
  subsp. aureus M899

SEQ ID NO: 40135 - protein, 339 aa, Staphylococcus aureus; identical to SEQ ID NO: 31219
  subsp. aureus M899

SEQ ID NO: 40136 - protein, 351 aa, Staphylococcus aureus; identical to SEQ ID NO: 33991
  subsp. aureus M899

SEQ ID NO: 40137 - protein, 231 aa, Staphylococcus aureus; identical to SEQ ID NO: 31216
  subsp. aureus M899

SEQ ID NO: 40138 - protein, 40 aa, Staphylococcus aureus; identical to SEQ ID NO: 31854
  subsp. aureus M899

SEQ ID NO: 40139 - protein, 808 aa, Staphylococcus aureus; identical to SEQ ID NO: 31215
  subsp. aureus M899

SEQ ID NO: 40140 - protein, 141 aa, Staphylococcus aureus; identical to SEQ ID NO: 31214
  subsp. aureus M899

SEQ ID NO: 40141 - protein, 321 aa, Staphylococcus aureus; identical to SEQ ID NO: 31900
  subsp. aureus M899

SEQ ID NO: 40142 - protein, 315 aa, Staphylococcus aureus; identical to SEQ ID NO: 31191
  subsp. aureus M899

SEQ ID NO: 40143 - protein, 325 aa, Staphylococcus aureus; identical to SEQ ID NO: 30479
  subsp. aureus M899

SEQ ID NO: 40144 - protein, 886 aa, Staphylococcus aureus; identical to SEQ ID NO: 33998
  subsp. aureus M899

SEQ ID NO: 40145 - protein, 1019 aa, Staphylococcus aureus; identical to SEQ ID NO: 35818
  subsp. aureus M899

SEQ ID NO: 40146 - protein, 996 aa, Staphylococcus aureus
  subsp. aureus MN8
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDVTSETNWKYKFKDLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVKGYTTHVDNNDMGNLIVTNKYTPETTSISGEKVWDDKDNQDGKRPEKVSVNLLANGEKVKTLDVTSETNWKYEFKNLPKYDEGKKIEYTVTEDHVKDYTTDINGTTITNKYTPGETSATVTKNWDDNNNQDGKRPTEIKVELYQDGKATGKTATLNESNNWTHTWTGLDEKAKGQQVKYTVEELTKVNGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 40147 - protein, 681 aa, Staphylococcus aureus; identical to SEQ ID NO: 34710
  subsp. aureus MN8

SEQ ID NO: 40148 - protein, 1351 aa, Staphylococcus aureus; identical to SEQ ID NO: 31203
  subsp. aureus MN8

SEQ ID NO: 40149 - protein, 879 aa, Staphylococcus aureus; identical to SEQ ID NO: 34708
  subsp. aureus MN8

SEQ ID NO: 40150 - protein, 233 aa, Staphylococcus aureus; identical to SEQ ID NO: 31039
  subsp. aureus MN8

SEQ ID NO: 40151 - protein, 973 aa, Staphylococcus aureus
  subsp. aureus MN8
MHLKGDIIVKNNLRYGIRKHKLGAASVFLGTMIVVGMGQDKEAAASEQKTTTVEENGNSATDNKVSETQTTTTNVNTIDETQSYSATATEQPSNATQVTTEEAPKAVQAPQTAQPANVETVKEEVVKEEANPQVKETTQSQDNSGDQRQVDLTPKKATQNQVAETQVEVAQPRTALESKPRVTRSTDVAEAKEASDAKVETGTDVTSKVTVEDESKIEAPKGNNVQPHEGQRVVLKYKLKFQDGLKTGDYFDFTLSNNVNTHGVATTRKVPDIKNGSLVMAKGQVLDNGRIRYTFTDYIKDKVNVTANLEINLFIDPKTVQSNGQQTITSKLNGKETSGTMQITYKDGVKNQYTNVNGSIETFDKEKNKFTHVAYIKPINGNNSDSVTVTGMLTQGSNENGTQPNVKIYEYVGVENGLPQSVYANTVDSTQLKDVTNQMGDKLKVQNNGSYSLNFDKLDKTYVIHYTGDYLNGTSEVNFRTQLTGYPENRYKTYYYYNNGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPGTPTPPTPEVPSEPGKPTPPTPEVPAEPGKPVPPAKEEPKKPSKPVEQGKVVTPVIEINEKVKAVAPTKQKQAKKSELPETGGEESTNKGMLFGGLFSILGLALLRRNKKNHKA

SEQ ID NO: 40152 - protein, 325 aa, Staphylococcus aureus; identical to SEQ ID NO: 30479
  subsp. aureus MN8

SEQ ID NO: 40153 - protein, 315 aa, Staphylococcus aureus; identical to SEQ ID NO: 31191
  subsp. aureus MN8

SEQ ID NO: 40154 - protein, 321 aa, Staphylococcus aureus; identical to SEQ ID NO: 31900
  subsp. aureus MN8

SEQ ID NO: 40155 - protein, 141 aa, Staphylococcus aureus; identical to SEQ ID NO: 31214
  subsp. aureus MN8

SEQ ID NO: 40156 - protein, 808 aa, Staphylococcus aureus; identical to SEQ ID NO: 31215
  subsp. aureus MN8

SEQ ID NO: 40157 - protein, 232 aa, Staphylococcus aureus; identical to SEQ ID NO: 31257
  subsp. aureus MN8

SEQ ID NO: 40158 - protein, 227 aa, Staphylococcus aureus; identical to SEQ ID NO: 30564
  subsp. aureus MN8

SEQ ID NO: 40159 - protein, 232 aa, Staphylococcus aureus; identical to SEQ ID NO: 30565
  subsp. aureus MN8

SEQ ID NO: 40160 - protein, 231 aa, Staphylococcus aureus; identical to SEQ ID NO: 30566
  subsp. aureus MN8

SEQ ID NO: 40161 - protein, 234 aa, Staphylococcus aureus; identical to SEQ ID NO: 30567
  subsp. aureus MN8

SEQ ID NO: 40162 - protein, 325 aa, Staphylococcus aureus; identical to SEQ ID NO: 33964
  subsp. aureus MN8

SEQ ID NO: 40163 - protein, 343 aa, Staphylococcus aureus; identical to SEQ ID NO: 31263
  subsp. aureus MN8

SEQ ID NO: 40164 - protein, 233 aa, Staphylococcus aureus; identical to SEQ ID NO: 31264
  subsp. aureus MN8

SEQ ID NO: 40165 - protein, 226 aa, Staphylococcus aureus; identical to SEQ ID NO: 31265
  subsp. aureus MN8

SEQ ID NO: 40166 - protein, 691 aa, Staphylococcus aureus; identical to SEQ ID NO: 31040
  subsp. aureus MN8

SEQ ID NO: 40167 - protein, 221 aa, Staphylococcus aureus; identical to SEQ ID NO: 31036
  subsp. aureus MN8

SEQ ID NO: 40168 - protein, 520 aa, Staphylococcus aureus; identical to SEQ ID NO: 36185
  subsp. aureus MN8

SEQ ID NO: 40169 - protein, 40 aa, Staphylococcus aureus; identical to SEQ ID NO: 31854
  subsp. aureus MN8

SEQ ID NO: 40170 - protein, 231 aa, Staphylococcus aureus; identical to SEQ ID NO: 31216
  subsp. aureus MN8

SEQ ID NO: 40171 - protein, 241 aa, Staphylococcus aureus; identical to SEQ ID NO: 30357
  subsp. aureus MN8

SEQ ID NO: 40172 - protein, 351 aa, Staphylococcus aureus; identical to SEQ ID NO: 31218
  subsp. aureus MN8

SEQ ID NO: 40173 - protein, 339 aa, Staphylococcus aureus; identical to SEQ ID NO: 31219
  subsp. aureus MN8

SEQ ID NO: 40174 - protein, 280 aa, Staphylococcus aureus; identical to SEQ ID NO: 34754
  subsp. aureus MN8

SEQ ID NO: 40175 - protein, 257 aa, Staphylococcus aureus; identical to SEQ ID NO: 31220
  subsp. aureus MN8

SEQ ID NO: 40176 - protein, 689 aa, Staphylococcus aureus; identical to SEQ ID NO: 31861
  subsp. aureus MN8

SEQ ID NO: 40177 - protein, 1017 aa, Staphylococcus aureus
  subsp. aureus MN8
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 40178 - protein, 434 aa, Staphylococcus aureus [sequence omitted]

SEQ ID NO: 40179 - protein, 1137 aa, Staphylococcus aureus; identical to SEQ ID NO: 31254
  subsp. aureus MN8

SEQ ID NO: 40180 - protein, 1514 aa, Staphylococcus aureus
  subsp. aureus MN8
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKDGKQDSSEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSDSDSDSDSDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 40181 - protein, 924 aa, Staphylococcus aureus; identical to SEQ ID NO: 34735
  subsp. aureus MN8

SEQ ID NO: 40182 - protein, 2787 aa, Staphylococcus aureus
  subsp. aureus MN8
MNYRDKIQKFSIRKYTVGTFSTVIATLVFLGLNTSQAQAAETNQPASALKQKQQNGDTQTENREVEVQNSQNGQSLSAPIENEQPNNNQTNHVDASAVQSSTTEHDQPVSQNEQAKKDTAAATPTQSAKAASKHEQSESRAANKKENDNKATHVESHEANVVTASDSSDSGNVQHDRNELQAFFDANYHDYRFIDRENADSGTFNYVKGIFDKINTLLGSNDPINNKDLQLAYKELEQAVALIRTMPQRQQTSRRSSRIQTRSIESRAAEPRSVSDYQNANSSYYVENANDGSGYPVGTYINASSKGAPYNLPTTPWNTLKASDAKEIALITAKQTGDGYQWVIKFNKGHAPHENMIYWFALPAGQTPVGRTEFVTVNADGTNVQWSNGAGAGANKPLPEMWPYGVNDSRSWDYKIRNRSGQVIYDWPTVHINSLKDLARASDYFSEAGATPATKAFGRQTFEYINGERPTESPGVPKVYTFIGKGDASYTISFKTQGPTIDKLYYAAGGRALEYNQLFMYSQLYVESTQDYQQRLNGLRQVVNRTYRIGTTKRVEVSQGNVQTKKVLESTNLNIDDFMDDPLSYVKTPSNKVLGFYPTSANTNAFRPGGVNPLNEYQLSQLFTDDKLQQAARTGSPIRLMIGFDYPDAFGNGETLVPVNLTVLPEIQHNIKFFKNDDGQNIADKPASKQAGHPVFYVYAGNQGNASVNLGGSVTSIQPLRINLTSNENFTDKDWQITGIPRTLHIENSTNRTNNARERNIELVGNLLPGDYFGTIRFGRKEQLFEIRVKPHTPRITTTAEELRGTALQKVPVTVTDIPLDPSALVYLVIPTSQTRDGGSEADQIPSGYTKIATGTPDGVHSTITIRPEDYVVFIPPVGNQIRALIFYNNVVASNMSNAVTILPDDIPPTINNPVGLNAKYYRGDEVSFTMGVSDRHSGLKSTTITTLPSGWTSNLTKSDKKNGSLAISGRVSMNQAYNSDITFKVSATDNVNNTTNDSQSKHVTVHVGKISDDAHPIVLGNSEKVVVVNPTALTGDEKQRITTAFMNKNQNIRGYLASSNPVTVDNHGNVTLQYRDGSSTTLDATNVMTYEPVVKPEYQTANAAKTATVTIAKGQSFNIGDIKQYFTLSNGQAIPSSSFTNITSDRTIPTAQEVSQMNAGTQLYHIVATNAYHKDTEDFYITLKIIDVKQPEGDQRVYRMSTYDITTDEISKVKQAFINANRDAISFAEGDISVTNTPNGSNVSTITVNINKGRLTKSFTSNLNNMNFLRWVNFPQDYTVTWTNAKIANRPTDGGLSWSDDHKSLIYRYDATLGTQITTNDILTLLKATTTVPGLRNNIAGNEKAQAEAGGRPNYKTTGYSQSNPTSDGQRQFTLNGQVIQIMDIINPSNGFGGQPVTNSNVRANHSNSTVVSVNESAANGAGAFTIDHVVKNNSTHNAADAVYKAQLYLSPYGPKQYVEHLNQNTDNTNEAINIYFVPSDLVNPTISVGNYTNHQVFSGETFTNTITANDNFGVQSVTVPTTSQLTGTVDNNHQHVSATAPNVTSTTNKTINLVATDTSGNTATTSFNVTIKPLRDKYRVGTSSTAANPVRIANISNNATVSQADQTAIINSLTFTSNAPNRNYATASANEITSKTVSNVSRTGNNAQVTVTVTYQDGTTSTVTVPVKRVIPEIVAHSHYTVQGQDFPTGNGASASDYFKLSNGSAIPDATITWVSGQAPNKNNTTIGQDINVTAHILIDGETTPITKTATYKVVRTVPKQVFETARGVLYPGVSDMYDAKQYVKPVNNSWSTNAQHMNFQFTNSYGPSKDVVGISTRDIRVTYDNHQTQIIKILSKVKPDPPRIDGNSVTYKAGLTNQQIKINNVLSSSSIKLFKADNTPLTITNTTYGSGNTAVVTVSDALPNGEIKARSSISMNNVTYTTQDEHGRAIDVTRNESVDSNDSASVHVTPQLQATTEGAVFIKGGDGFDFGHVERFIQNPPHGATVAWHDNPDTWKNTVGNTHKTAVVTLPNGQGTRNVEVPVKVYPVANAKAPSRDVKGQNLTNGTDAINYITFDPNTNTNGITAVWANRQQPNNQQAGVQHLNVDVTYPGISAAKRVPVTVNVYQFEFPQTSYTTTVGGTLASGTQASGYAHIQNATGLPTDGFTYKWNNAATGTNDANWAAMNKPNTAQVINAKYDVIYNGHTFATSLPAKFVVKDVQPAKPTVTETAAGVITIAPGANQTVNTHAGNVTTYADKLVIKRNGNVVTTFTRHNNTSPWVKEASAANVAGIAGTNNGITVAAGTFNPADTIQAVATQGSGETISDEQRSDDFTVVAPQPNQATTKIWQNGHVDITPNNPSGHLINPTQAMDIAYTEKVGNGAEHSKTLNAVRGQNNQWTIANKPDYVTLDAHTGKVTFNANTIKPNSAITITPKAGTGHSASSNPSTLTAPAAHTVNTTEIVKDYGSNVTAAEINNAVQVANKRTATIKNGTAMPTNLAGGSTTTIPVTVTYNDSSTEEVQESIFTKADKRELITAKNHLDDPVSTDGKKPGTITQYNNAIHNAQQQINTAKTEAQQVINDERATPQQVNAALSKVQAAQTKINEAKALLQNKEDNSQLVTSKNNLQSSVNQVPSTTGMTQQSIDNYNAKKREAESEITAAQRVIDNGDATAQQISDEKHRVDNALTALNQAKQNLTADTHELEQAVHQLNRTGTTTGKKPASITAYNNSIRALQSDLTSAKNSANAIIQKPIRSVQEVQTALTNVNRVNDRLTLAINQLVPLADNSALRTAKTNLMKKSINQ

SEQ ID NO: 40183 - protein, 372 aa, Staphylococcus aureus; identical to SEQ ID NO: 33950
  subsp. aureus MN8

SEQ ID NO: 40184 - protein, 251 aa, Staphylococcus aureus; identical to SEQ ID NO: 35953
  subsp. aureus MN8

SEQ ID NO: 40185 - protein, 273 aa, Staphylococcus aureus; identical to SEQ ID NO: 38702
  subsp. aureus MN8

SEQ ID NO: 40186 - protein, 247 aa, Staphylococcus aureus; identical to SEQ ID NO: 31904
  subsp. aureus MN8

SEQ ID NO: 40187 - protein, 115 aa, Staphylococcus aureus; identical to SEQ ID NO: 38700
  subsp. aureus MN8

SEQ ID NO: 40188 - protein, 206 aa, Staphylococcus aureus; identical to SEQ ID NO: 34750
  subsp. aureus MN8

SEQ ID NO: 40189 - protein, 165 aa, Staphylococcus aureus; identical to SEQ ID NO: 31241
  subsp. aureus MN8

SEQ ID NO: 40190 - protein, 105 aa, Staphylococcus aureus; identical to SEQ ID NO: 31168
  subsp. aureus MN8

SEQ ID NO: 40191 - protein, 354 aa, Staphylococcus aureus; identical to SEQ ID NO: 30412
  subsp. aureus MN8

SEQ ID NO: 40192 - protein, 652 aa, Staphylococcus aureus; identical to SEQ ID NO: 34746
  subsp. aureus MN8

SEQ ID NO: 40193 - protein, 254 aa, Staphylococcus aureus; identical to SEQ ID NO: 31226
  subsp. aureus MN8

SEQ ID NO: 40194 - protein, 239 aa, Staphylococcus aureus; identical to SEQ ID NO: 30171
  subsp. aureus MN8

SEQ ID NO: 40195 - protein, 242 aa, Staphylococcus aureus; identical to SEQ ID NO: 30522
  subsp. aureus MN8

SEQ ID NO: 40196 - protein, 261 aa, Staphylococcus aureus; identical to SEQ ID NO: 30506
  subsp. aureus MN8

SEQ ID NO: 40197 - protein, 251 aa, Staphylococcus aureus; identical to SEQ ID NO: 30505
  subsp. aureus MN8

SEQ ID NO: 40198 - protein, 258 aa, Staphylococcus aureus; identical to SEQ ID NO: 30518
  subsp. aureus MN8

SEQ ID NO: 40199 - protein, 806 aa, Staphylococcus aureus; identical to SEQ ID NO: 31234
  subsp. aureus MN8

SEQ ID NO: 40200 - protein, 331 aa, Staphylococcus aureus; identical to SEQ ID NO: 31235
  subsp. aureus MN8

SEQ ID NO: 40201 - protein, 2189 aa, Staphylococcus aureus; identical to SEQ ID NO: 31236
  subsp. aureus MN8

SEQ ID NO: 40202 - protein, 278 aa, Staphylococcus aureus; identical to SEQ ID NO: 34714
  subsp. aureus MN8

SEQ ID NO: 40203 - protein, 291 aa, Staphylococcus aureus; identical to SEQ ID NO: 30390
  subsp. aureus MN8

SEQ ID NO: 40204 - protein, 167 aa, Staphylococcus aureus; identical to SEQ ID NO: 31885
  subsp. aureus MN8

SEQ ID NO: 40205 - protein, 62 aa, Staphylococcus aureus; identical to SEQ ID NO: 31886
  subsp. aureus MN8

SEQ ID NO: 40206 - protein, 2478 aa, Staphylococcus aureus; identical to SEQ ID NO: 31939
  subsp. aureus MRSA131

SEQ ID NO: 40207 - protein, 895 aa, Staphylococcus aureus
  subsp. aureus MRSA131
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDSTQELKIVSSTQIDDGEETNYDYTKLVFAKPIYNDPSLVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 40208 - protein, 51 aa, Staphylococcus aureus; identical to SEQ ID NO: 32234
  subsp. aureus MRSA131

SEQ ID NO: 40209 - protein, 960 aa, Staphylococcus aureus
  subsp. aureus MRSA131
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEPSTSEIQTKPTTPQESTNIENSQLQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSD

SEQ ID NO: 40210 - protein, 1156 aa, Staphylococcus aureus
  subsp. aureus MRSA131
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYYEEETSDSDSDSDSDSDSDRDSDSDSDSDSDSDSDSDS

SEQ ID NO: 40211 - protein, 83 aa, Staphylococcus aureus
  subsp. aureus MRSA131
DSDSDSDSDSDNDSDSDSDSDSDAGKHTPAKPMSTVKDQHKTAKALPETGSENNNSNNGTLFGGLFAALGSLLLFGRRKKQNK

SEQ ID NO: 40212 - protein, 818 aa, Staphylococcus aureus
  subsp. aureus MRSA131
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYNWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTVTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 40213 - protein, 691 aa, Staphylococcus aureus
  subsp. aureus MRSA131
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSESDSDSESDSESDSDSDSDSDSDSDSDSDSDSDSDSDSDSDSDSDSD

SEQ ID NO: 40214 - protein, 91 aa, Staphylococcus aureus; identical to SEQ ID NO: 38368
  subsp. aureus MRSA131

SEQ ID NO: 40215 - protein, 681 aa, Staphylococcus aureus; identical to SEQ ID NO: 32025
  subsp. aureus MRSA131

SEQ ID NO: 40216 - protein, 372 aa, Staphylococcus aureus; identical to SEQ ID NO: 31084
  subsp. aureus MRSA131

SEQ ID NO: 40217 - protein, 241 aa, Staphylococcus aureus
  subsp. aureus MRSA131
MKKNIMNKLVLSTALLLLETTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPRNAEVEVILEKSN

SEQ ID NO: 40218 - protein, 241 aa, Staphylococcus aureus; identical to SEQ ID NO: 30739
  subsp. aureus MRSA131

SEQ ID NO: 40219 - protein, 271 aa, Staphylococcus aureus; identical to SEQ ID NO: 36139
  subsp. aureus MRSA131

SEQ ID NO: 40220 - protein, 322 aa, Staphylococcus aureus
  subsp. aureus MRSA131
MMKMKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 40221 - protein, 165 aa, Staphylococcus aureus; identical to SEQ ID NO: 30742
  subsp. aureus MRSA131

SEQ ID NO: 40222 - protein, 109 aa, Staphylococcus aureus; identical to SEQ ID NO: 30744
  subsp. aureus MRSA131

SEQ ID NO: 40223 - protein, 350 aa, Staphylococcus aureus; identical to SEQ ID NO: 30602
  subsp. aureus MRSA131

SEQ ID NO: 40224 - protein, 631 aa, Staphylococcus aureus
  subsp. aureus MRSA131
MNKQQKEFKSFYSIRKSSLGVASVAISTLLLLMSNGEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 40225 - protein, 244 aa, Staphylococcus aureus; identical to SEQ ID NO: 30361
  subsp. aureus MRSA131

SEQ ID NO: 40226 - protein, 242 aa, Staphylococcus aureus; identical to SEQ ID NO: 31991
  subsp. aureus MRSA131

SEQ ID NO: 40227 - protein, 2186 aa, Staphylococcus aureus; identical to SEQ ID NO: 31059
  subsp. aureus MRSA131

SEQ ID NO: 40228 - protein, 231 aa, Staphylococcus aureus; identical to SEQ ID NO: 31073
  subsp. aureus MRSA131

SEQ ID NO: 40229 - protein, 331 aa, Staphylococcus aureus; identical to SEQ ID NO: 30732
  subsp. aureus MRSA131

SEQ ID NO: 40230 - protein, 327 aa, Staphylococcus aureus; identical to SEQ ID NO: 30538
  subsp. aureus MRSA131

SEQ ID NO: 40231 - protein, 311 aa, Staphylococcus aureus; identical to SEQ ID NO: 30617
  subsp. aureus MRSA131

SEQ ID NO: 40232 - protein, 291 aa, Staphylococcus aureus; identical to SEQ ID NO: 30390
  subsp. aureus MRSA131

SEQ ID NO: 40233 - protein, 250 aa, Staphylococcus aureus; identical to SEQ ID NO: 31910
  subsp. aureus MRSA131

SEQ ID NO: 40234 - protein, 312 aa, Staphylococcus aureus; identical to SEQ ID NO: 30196
  subsp. aureus MRSA131

SEQ ID NO: 40235 - protein, 325 aa, Staphylococcus aureus; identical to SEQ ID NO: 30484
  subsp. aureus MRSA131

SEQ ID NO: 40236 - protein, 141 aa, Staphylococcus aureus; identical to SEQ ID NO: 30715
  subsp. aureus MRSA131

SEQ ID NO: 40237 - protein, 807 aa, Staphylococcus aureus; identical to SEQ ID NO: 30716
  subsp. aureus MRSA131

SEQ ID NO: 40238 - protein, 185 aa, Staphylococcus aureus
  subsp. aureus MRSA131
SDSDSDSDSDSDSDSDSDSASDSDSDSDSDSDSDSDSDSDSDSDSDSDSDSDSDSDSDSESDSDSESDSDSESDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 40239 - protein, 701 aa, Staphylococcus aureus
  subsp. aureus MRSA131
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDS

SEQ ID NO: 40240 - protein, 434 aa, Staphylococcus aureus [sequence omitted]

SEQ ID NO: 40241 - protein, 90 aa, Staphylococcus aureus
  subsp. aureus MRSA131
SDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 40242 - protein, 259 aa, Staphylococcus aureus; identical to SEQ ID NO: 30226
  subsp. aureus MRSA131

SEQ ID NO: 40243 - protein, 268 aa, Staphylococcus aureus; identical to SEQ ID NO: 30398
  subsp. aureus MRSA131

SEQ ID NO: 40244 - protein, 268 aa, Staphylococcus aureus
  subsp. aureus MRSA131
MLKFIEKRWNMKKFNILIALLFFTSLVISPLNVKANENIDSVKEKELHKKSELSSTALNNMKHSYADKNPIIGENKSTGDQFLENTLLYKKFFTDLINFEDLLINFNSKEMAQHFKSKNVDVYAIRYSINCYGGEIDRTACTYGGVTPHEGNKLKERKKIPINLWINGVQKEVSLDKVQTDKKNVTVQELDAQARRYLQKDLKLYNNDTLGGKIQRGKIEFDSSDGSKVSYDLFDVKGDFPEKQLRIYSDNKTLSTEHLHIDIYLYEK

SEQ ID NO: 40245 - protein, 351 aa, Staphylococcus aureus; identical to SEQ ID NO: 30720
  subsp. aureus MRSA131

SEQ ID NO: 40246 - protein, 338 aa, Staphylococcus aureus; identical to SEQ ID NO: 30699
  subsp. aureus MRSA131

SEQ ID NO: 40247 - protein, 274 aa, Staphylococcus aureus; identical to SEQ ID NO: 30872
  subsp. aureus MRSA131

SEQ ID NO: 40248 - protein, 96 aa, Staphylococcus aureus; identical to SEQ ID NO: 30813
  subsp. aureus MRSA131

SEQ ID NO: 40249 - protein, 438 aa, Staphylococcus aureus
  subsp. aureus MRSA131
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDGNKPGKEDNKKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40250 - protein, 241 aa, Staphylococcus aureus
  subsp. aureus MRSA131
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMQQGHMQSSNHQIMSPKANMHSSNHQMNQSNKKVLPAAGESMTSSILTASIAALLLVSGLFLAFRRRSTNK

SEQ ID NO: 40251 - protein, 690 aa, Staphylococcus aureus; identical to SEQ ID NO: 30419
  subsp. aureus MRSA131

SEQ ID NO: 40252 - protein, 225 aa, Staphylococcus aureus; identical to SEQ ID NO: 30763
  subsp. aureus MRSA131

SEQ ID NO: 40253 - protein, 227 aa, Staphylococcus aureus; identical to SEQ ID NO: 30585
  subsp. aureus MRSA131

SEQ ID NO: 40254 - protein, 232 aa, Staphylococcus aureus; identical to SEQ ID NO: 30765
  subsp. aureus MRSA131

SEQ ID NO: 40255 - protein, 234 aa, Staphylococcus aureus; identical to SEQ ID NO: 32347
  subsp. aureus MRSA131

SEQ ID NO: 40256 - protein, 231 aa, Staphylococcus aureus; identical to SEQ ID NO: 30560
  subsp. aureus MRSA131

SEQ ID NO: 40257 - protein, 205 aa, Staphylococcus aureus
  subsp. aureus MRSA131
MKLKTLAKATLVLGLLATGVITTESQTVKAAESTQGQHNYKSLKYYYSKPSIELKNLDGLYRQKVTDKGVYVWKDRKDYFVGLLGKDIEKYPQGEHDKQDAFLVIEEETVNGRQYSIGGLSKTNSKEFSKEVDVKVTRKIDESSEKSKDSKFKITKEEISLKELDFKLRKKLMEEEKLYGAVNNRKGKIVVKMEDDKFYTFELTK

SEQ ID NO: 40258 - protein, 239 aa, Staphylococcus aureus; identical to SEQ ID NO: 31982
  subsp. aureus MRSA131

SEQ ID NO: 40259 - protein, 313 aa, Staphylococcus aureus
  subsp. aureus MRSA131
MEHTTMKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 40260 - protein, 352 aa, Staphylococcus aureus; identical to SEQ ID NO: 30767
  subsp. aureus MRSA131

SEQ ID NO: 40261 - protein, 231 aa, Staphylococcus aureus; identical to SEQ ID NO: 30768
  subsp. aureus MRSA131

SEQ ID NO: 40262 - protein, 226 aa, Staphylococcus aureus; identical to SEQ ID NO: 30769
  subsp. aureus MRSA131

SEQ ID NO: 40263 - protein, 203 aa, Staphylococcus aureus; identical to SEQ ID NO: 30770
  subsp. aureus MRSA131

SEQ ID NO: 40264 - protein, 321 aa, Staphylococcus aureus; identical to SEQ ID NO: 30959
  subsp. aureus MRSA131

SEQ ID NO: 40265 - protein, 318 aa, Staphylococcus aureus; identical to SEQ ID NO: 36100
  subsp. aureus MRSA131

SEQ ID NO: 40266 - protein, 325 aa, Staphylococcus aureus; identical to SEQ ID NO: 30407
  subsp. aureus MRSA131

SEQ ID NO: 40267 - protein, 861 aa, Staphylococcus aureus
  subsp. aureus MRSA131
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 40268 - protein, 827 aa, Staphylococcus aureus
  subsp. aureus MRSA131
MKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPE

SEQ ID NO: 40269 - protein, 115 aa, Staphylococcus aureus
  subsp. aureus MRSA131
PETPTPPTPEVPSEPETPTPPTPEVPAEPGKPVPPAKEEPKKPSKPVEQGKVVTPVIEINEKVKAVVPTKKAQSKKSELPETGGEESTNNGMLFGGLFSILGLALLRRNKKNHKA

SEQ ID NO: 40270 - protein, 826 aa, Staphylococcus aureus
  subsp. aureus MRSA131
MHLKGDIIVKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPH

SEQ ID NO: 40271 - protein, 233 aa, Staphylococcus aureus; identical to SEQ ID NO: 30428
  subsp. aureus MRSA131

SEQ ID NO: 40272 - protein, 93 aa, Staphylococcus aureus; identical to SEQ ID NO: 38325
  subsp. aureus MRSA131

SEQ ID NO: 40273 - protein, 98 aa, Staphylococcus aureus
  subsp. aureus MRSA177
SDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 40274 - protein, 233 aa, Staphylococcus aureus; identical to SEQ ID NO: 30428
  subsp. aureus MRSA177

SEQ ID NO: 40275 - protein, 1026 aa, Staphylococcus aureus
  subsp. aureus MRSA177
MHLKGDIIVKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNGKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITENNHHISHSGLGTENGHGNYGVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPNYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVVPTKKAQSKKSELPETGGEESTNKGMLFGGLFSILGLALLRRNKKNHKA

SEQ ID NO: 40276 - protein, 792 aa, Staphylococcus aureus
  subsp. aureus MRSA177
MKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLP

SEQ ID NO: 40277 - protein, 372 aa, Staphylococcus aureus; identical to SEQ ID NO: 31084
  subsp. aureus MRSA177

SEQ ID NO: 40278 - protein, 681 aa, Staphylococcus aureus; identical to SEQ ID NO: 32025
  subsp. aureus MRSA177

SEQ ID NO: 40279 - protein, 91 aa, Staphylococcus aureus; identical to SEQ ID NO: 38368
  subsp. aureus MRSA177

SEQ ID NO: 40280 - protein, 691 aa, Staphylococcus aureus
  subsp. aureus MRSA177
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDISKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSESDSDSESDSESDSDSDSDSDSDSDSDSDSDSDSDSDSDSDSDSDSD

SEQ ID NO: 40281 - protein, 291 aa, Staphylococcus aureus
  subsp. aureus MRSA177
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVSAVLLELGYISNPTDETMIKDQLHRQILEQAIVDGLKIYFSA

SEQ ID NO: 40282 - protein, 250 aa, Staphylococcus aureus; identical to SEQ ID NO: 31910
  subsp. aureus MRSA177

SEQ ID NO: 40283 - protein, 895 aa, Staphylococcus aureus; identical to SEQ ID NO: 30734
  subsp. aureus MRSA177

SEQ ID NO: 40284 - protein, 2186 aa, Staphylococcus aureus; identical to SEQ ID NO: 31059
  subsp. aureus MRSA177

SEQ ID NO: 40285 - protein, 331 aa, Staphylococcus aureus; identical to SEQ ID NO: 30732
  subsp. aureus MRSA177

SEQ ID NO: 40286 - protein, 231 aa, Staphylococcus aureus; identical to SEQ ID NO: 31073
  subsp. aureus MRSA177

SEQ ID NO: 40287 - protein, 351 aa, Staphylococcus aureus; identical to SEQ ID NO: 30720
  subsp. aureus MRSA177

SEQ ID NO: 40288 - protein, 338 aa, Staphylococcus aureus; identical to SEQ ID NO: 30699
  subsp. aureus MRSA177

SEQ ID NO: 40289 - protein, 274 aa, Staphylococcus aureus; identical to SEQ ID NO: 30872
  subsp. aureus MRSA177

SEQ ID NO: 40290 - protein, 1102 aa, Staphylococcus aureus; identical to SEQ ID NO: 32042
  subsp. aureus MRSA177

SEQ ID NO: 40291 - protein, 141 aa, Staphylococcus aureus; identical to SEQ ID NO: 30715
  subsp. aureus MRSA177

SEQ ID NO: 40292 - protein, 807 aa, Staphylococcus aureus; identical to SEQ ID NO: 30716
  subsp. aureus MRSA177

SEQ ID NO: 40293 - protein, 327 aa, Staphylococcus aureus; identical to SEQ ID NO: 30538
  subsp. aureus MRSA177

SEQ ID NO: 40294 - protein, 311 aa, Staphylococcus aureus; identical to SEQ ID NO: 30617
  subsp. aureus MRSA177

SEQ ID NO: 40295 - protein, 241 aa, Staphylococcus aureus; identical to SEQ ID NO: 30738
  subsp. aureus MRSA177

SEQ ID NO: 40296 - protein, 241 aa, Staphylococcus aureus; identical to SEQ ID NO: 30739
  subsp. aureus MRSA177

SEQ ID NO: 40297 - protein, 271 aa, Staphylococcus aureus; identical to SEQ ID NO: 36139
  subsp. aureus MRSA177

SEQ ID NO: 40298 - protein, 322 aa, Staphylococcus aureus; identical to SEQ ID NO: 40220
  subsp. aureus MRSA177

SEQ ID NO: 40299 - protein, 165 aa, Staphylococcus aureus; identical to SEQ ID NO: 30742
  subsp. aureus MRSA177

SEQ ID NO: 40300 - protein, 109 aa, Staphylococcus aureus; identical to SEQ ID NO: 30744
  subsp. aureus MRSA177

SEQ ID NO: 40301 - protein, 350 aa, Staphylococcus aureus; identical to SEQ ID NO: 30602
  subsp. aureus MRSA177

SEQ ID NO: 40302 - protein, 645 aa, Staphylococcus aureus; identical to SEQ ID NO: 30747
  subsp. aureus MRSA177

SEQ ID NO: 40303 - protein, 145 aa, Staphylococcus aureus
  subsp. aureus MRSA177
MKMNKIFRVLTVSLFFFTFLIKNNLAYADVGVINLRNFYTNYQPETLQGVSSGNFSTSHQLEYIDGKYTLYSQFHNEYEAKRLKDHKVDIFGISYSGLCNTKYMYGGITLANQNLDKPRNIPINLWVNGKQNTISTDEVSTQKKR

SEQ ID NO: 40304 - protein, 242 aa, Staphylococcus aureus; identical to SEQ ID NO: 31991
  subsp. aureus MRSA177

SEQ ID NO: 40305 - protein, 225 aa, Staphylococcus aureus; identical to SEQ ID NO: 30763
  subsp. aureus MRSA177

SEQ ID NO: 40306 - protein, 227 aa, Staphylococcus aureus; identical to SEQ ID NO: 30585
  subsp. aureus MRSA177

SEQ ID NO: 40307 - protein, 232 aa, Staphylococcus aureus; identical to SEQ ID NO: 30765
  subsp. aureus MRSA177

SEQ ID NO: 40308 - protein, 234 aa, Staphylococcus aureus; identical to SEQ ID NO: 32347
  subsp. aureus MRSA177

SEQ ID NO: 40309 - protein, 231 aa, Staphylococcus aureus; identical to SEQ ID NO: 30560
  subsp. aureus MRSA177

SEQ ID NO: 40310 - protein, 231 aa, Staphylococcus aureus; identical to SEQ ID NO: 31761
  subsp. aureus MRSA177

SEQ ID NO: 40311 - protein, 239 aa, Staphylococcus aureus; identical to SEQ ID NO: 31982
  subsp. aureus MRSA177

SEQ ID NO: 40312 - protein, 63 aa, Staphylococcus aureus
  subsp. aureus MRSA177
DFKLRKQLIEKNNLYGNVGSGKIVIKMKNGGKYTFELHKKLQENRMADVIDGTNIDNIEVNIK

SEQ ID NO: 40313 - protein, 260 aa, Staphylococcus aureus
  subsp. aureus MRSA177
MEHTTMKITTIAKTSLALGLLTTGVITTTTQAANATTPSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIE

SEQ ID NO: 40314 - protein, 59 aa, Staphylococcus aureus
  subsp. aureus MRSA177
DFKLRKQLIEKHNLYGNMGSGTIVIKMKNGGKYTFELHKKLQEHRMAGTNIDNIEVNIK

SEQ ID NO: 40315 - protein, 203 aa, Staphylococcus aureus; identical to SEQ ID NO: 30770
  subsp. aureus MRSA177

SEQ ID NO: 40316 - protein, 690 aa, Staphylococcus aureus; identical to SEQ ID NO: 31973
  subsp. aureus MRSA177

SEQ ID NO: 40317 - protein, 303 aa, Staphylococcus aureus
  subsp. aureus MRSA177
MKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIE

SEQ ID NO: 40318 - protein, 231 aa, Staphylococcus aureus; identical to SEQ ID NO: 30768
  subsp. aureus MRSA177

SEQ ID NO: 40319 - protein, 226 aa, Staphylococcus aureus; identical to SEQ ID NO: 30769
  subsp. aureus MRSA177

SEQ ID NO: 40320 - protein, 325 aa, Staphylococcus aureus; identical to SEQ ID NO: 30484
  subsp. aureus MRSA177

SEQ ID NO: 40321 - protein, 315 aa, Staphylococcus aureus
  subsp. aureus MRSA177
MIFMVKKRLLAATLSLGIITPIATSFHESKADNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 40322 - protein, 252 aa, Staphylococcus aureus
  subsp. aureus MRSA177
GESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 40323 - protein, 325 aa, Staphylococcus aureus; identical to SEQ ID NO: 30407
  subsp. aureus MRSA177

SEQ ID NO: 40324 - protein, 315 aa, Staphylococcus aureus; identical to SEQ ID NO: 30440
  subsp. aureus MRSA177

SEQ ID NO: 40325 - protein, 321 aa, Staphylococcus aureus; identical to SEQ ID NO: 30959
  subsp. aureus MRSA177

SEQ ID NO: 40326 - protein, 96 aa, Staphylococcus aureus; identical to SEQ ID NO: 30813
  subsp. aureus MRSA177

SEQ ID NO: 40327 - protein, 241 aa, Staphylococcus aureus; identical to SEQ ID NO: 30776
  subsp. aureus MRSA177

SEQ ID NO: 40328 - protein, 512 aa, Staphylococcus aureus
  subsp. aureus MRSA177
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILHLPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40329 - protein, 446 aa, Staphylococcus aureus
  subsp. aureus MRSA177
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKLKRFHSRKNVNLIRI

SEQ ID NO: 40330 - protein, 106 aa, Staphylococcus aureus
  subsp. aureus MRSA177
EVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 40331 - protein, 941 aa, Staphylococcus aureus
  subsp. aureus MRSA177
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDIFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 40332 - protein, 1355 aa, Staphylococcus aureus
  subsp. aureus MRSA177
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTGTNTTEDDKDADGGEVDVTITDHDDFTLDNGYYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 40333 - protein, 434 aa, Staphylococcus aureus [sequence omitted]

SEQ ID NO: 40334 - protein, 638 aa, Staphylococcus aureus
  subsp. aureus MRSA177
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSD

SEQ ID NO: 40335 - protein, 458 aa, Staphylococcus aureus
  subsp. aureus MSHR1132
MKKKNIYSIRKLGVGIASVTLGTLLISGGVTPAANAAQHNEAQQNAFYQVLNMPNLNAEQRNGFIQSLKDDPSQSANVLGEAQKLNDSQAPKAEAQQNNFNKDQQSAFYQILNMPNLNEEQRNGFIQSLKDDPSQSNNLLGEAQKLNDSQAPKADNKFNQEQQNAFYEILHLPNLNEEQRNGFIQSLKDDPSQSANLLAEAKKLNDSQAPKADNKFNKEQQNAFYEILHLPNLTEEQRNGFIQSLKDDPSVSKEILAEAKKLNDAQAPKDEDNNKPGKEDGNKPGKEDGNKPGKEDGNKPGKEDGNKPGKEDGNKPGKEDGNKPGKEDGNKPGKEDGNKPGKEDGNKPGKEDGNKPGKEDGNGVHVVKPGDTVNDIAKAHGTTADKIAADNKLADKNMIKPGQELVVDKKQQANHAEANKAQALPETGEENPFIGTTVFGGLSLALGAALLAGRRREL

SEQ ID NO: 40336 - protein, 434 aa, Staphylococcus aureus
  subsp. aureus MSHR1132
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGAKTFKESLRWGTEIFHNLKSILSKRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 40337 - protein, 1076 aa, Staphylococcus aureus
  subsp. aureus MSHR1132
MNMKKKEKHAIRKNSLGVASVLLGTLIGFGLLSSKEADASENSVTQSDSSSSEDKSKESSNVNASPQTDNTNTATNANDSGSEVAQSTAQQETTQQTNTATATEVTPTTAEQTTTTVNETSASNDAQSTTTNQNTTPETTQSNSTTGEQPTNKEELVNQPSNTTASNDTNDVSSVNSPQNSTNTDNVSSTQDTSTETTPSNNESTIQNKDVVNNAVNTSTPRMRAFSLAAVAADAASGSDITDQLTDVKVAINSGDTVYPHQAGYVNLNYAFSVPNSAVKGDTFKITVPKELNLNGVTSTAKVPPIMAGDQVLANGVIDSDGNVIYTFTDYVDNKENVTASINMPAYIDPENVTHTGNVTLTTGIGSNTASKTVLVDYEKYGKFYNLSIKGTIDQIDKTNNTYRQTIYVNPSGDNVIAPVLTGNLKPNTNSNALIDKNNTDIKVYKVDNTADLSESYYVNPDNFEDVTSSVNITFPNPNQYKVEFNTPDDQITTPYIVVVNGHIDPNSTGDLALRSTLYGYNSNFVWRSMSWDNEVAFNNGSGSGDGIDKPVVPEQPDEPGEIEPIPEDSDSDSTSDSGSDSGSGSDSTSDSTSDSGSDSGSDSTSDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSDSDSDSDSDSDSDSDSDSESDSGSDSDSDSGSDSDSDSDSDSGSDSDSGSDSDSGSDSGSDSDSDSDSDSDSDSDSDSGSDSDSGSDSDSGSDSGSDSDSDSDSDSDSGNDSDSGSDSDSDSDSDSGSDSGSDSDSDSDSDSDSGNDSDSGSDSDSDSDSDSDSDSDSNNAFDPAKDTESKGNVVPPNTSQNDVNATDKKEDKNSKEPLPDTGSDDSTNTSLIWGFLASLGSLLLFRRKKENKDKK

SEQ ID NO: 40338 - protein, 646 aa, Staphylococcus aureus
  subsp. aureus MSHR1132
MNKQQKEFKSFYSIRKSTLGVASVAISTLFLMMSNGEAQAAEESANINAQSQPKTEAVANPTSSPSENKASEKATETVTKKTPVAEAVSVSNKEAAPINEAKEVKEEKPVAKANNNAVAIDNQELREAIKNPAIKDKDHSATNSRPIDFEMKKENGERQFYHYASTVKPAKVIFDKNKTEIELGLQSGQFWRKFEIYEGDKKLPIKLVSYDTVKDYAYIRFPVSNGTKAVKIVSSIDFNNKEEKYDYTLMEFAQPITNKASDFKNDEDYKTEKLLAPYNKAKTLERQIYELKKIQDKLPEKLKAEYKKKLEDTQKALDEQMKSAVTEFQNVQPTNEKLTDLQDTKYVVYESVENNESMMDTFVKHPIKTGMLNGKKYMIMETTNDDYWKDFIVEGQRVKTISKDAKNNTRTIIFPYVDGKTLYNAIVKVHVKTIDYDGQYHVRIVDKEAFTKANAEKSNKKEQKDNSAQKAPVPATPEKTTPAPAEKEASKQNNKKVEKDKAPSVEKESGESKESSKAETPATKPDNSTVESSSTKPSKVVSTTQNVAKPASTTSESPKNVTQTSVGSSEVKEASQPSASLQKSSLKDVNTAQSSTKQNSNVAKENKAQTLPNTGEESNKDMTLPLMALIALSSIVAFVLPRKRKN

SEQ ID NO: 40339 - protein, 109 aa, Staphylococcus aureus
  subsp. aureus MSHR1132
MKKNFIGKSILSVAAVSLTVSMFAGESHAQTKNVEAANKYNQYQANFKKQVNKKVVDAQKAVNLFKRTRTVATHRKAQRAVNLIHFQHSYEKKKLQRQIDLVLKYNTLK

SEQ ID NO: 40340 - protein, 165 aa, Staphylococcus aureus
  subsp. aureus MSHR1132
MKNKLIAKTLLTIAAIGVTTTTIASTADASESYGPREKKPVSISHNIVEYNDGTFKYQSRPIFNKTPKYIKIRHDYNIVEYNDGTFGYGARPHFNKPAVKNEATIKKEQKLINAQNLVKEFEKTHTVSAHRKAQKAVNLVSFEYNVKKMVLQERIDNVLKQGFVK

SEQ ID NO: 40341 - protein, 319 aa, Staphylococcus aureus
  subsp. aureus MSHR1132
MKTRTVSLVTSTLLVTSILLNPIAHAADSDINIKPGTTDIGSNTTIKTGDLVTYDKVNGLHKKIFYSFIDDKNHNKKLLVIRTKGTIAGQYRVYSEEGSNKSGLAWPSAFKVHLEIPDNEAAQISDYYPRNSIDTKEYMSTLNYGFNGSISADDTGKIGGQIGGTVSIGHTLKYVQPDFKTILESPTDKKVGWKVIFNNMMNQNWGPYDRDSWNPIYGNQLFMKTRNGSMKASENFLDPNKASSLLSSGFSPDFATVLVMDRKAQNQQTNIDIVYERVRDDYQLHWTSTNWKGTNTKDKWTDRSSERYKIDWKKEEMTN

SEQ ID NO: 40342 - protein, 239 aa, Staphylococcus aureus
  subsp. aureus MSHR1132
MKKNITKKIILITSLLLLGTTTTTQSPKVLSGLSSEAKAYNINQDETNVNELIKYYTQSYLLFSNKWLRQSESGNIYVDFNRYTWSAHIQVKGNQSWGNINQLRDRYVDVFGLKDKETSQFWWSYQETFTGGVTPAASPSDKLYKIFVQYKDKLQTIIGAHVIYRGNKPVLTLKELDFRVRESLIKNKILYNENRNNGKLTITGGDNNFTIDLNKRLHSDYANVYVKNPQKIIVEVIID

SEQ ID NO: 40343 - protein, 242 aa, Staphylococcus aureus
  subsp. aureus MSHR1132
MKKKCTKKIILATTLLLLGTTATTQFPKTLSNFSSEAKAYYISQDETNVDELIKYYNQKHLSFSNKWLWQKDNGTIHATLLQLSWFSHIQVFGPESWGNINQLRNKYVDIFGIKDAETKNSYMLAQEIFTGGVTPAATSADKNYTLNVSYKDAAETFTGGYPLYSGNKPVLTLKELDFRIRQLLIKNKRLYIDKYNKGQIKITDGNNQYIIDLSKRLKSTDANRYVKDPRNAKIEVILEKSS

SEQ ID NO: 40344 - protein, 241 aa, Staphylococcus aureus
  subsp. aureus MSHR1132
MKKNITQKIILSTALLLLGTTSAHFPNASISFSSEAKAYNIRENETNINELIKYYTQPHLSFSGKWLWQNPNGTIHATLQTWVWYSHIQIYGPESWGNINKLRDKYVDIFGTKDEETVEGYLTYDETFTGGVTPAATSSDKPYKLFVEYRDKKQTIIGGHEVYQGNKPVLTLKELDFRVRQTLIKNKKLYNDGYNKGKINITGGGNNYTIDLSKKLKLTDTNRYVKDPRNAKIEVILEKSN

SEQ ID NO: 40345 - protein, 372 aa, Staphylococcus aureus
  subsp. aureus MSHR1132
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVVNNNEPTKEIKIANLEAQNSNQKKMNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWSHLYGHGLKGNGAKDIPYANNFNSEAKIYHNTPTFKAEPGDLVVFSGRFDGGYGHTAIVLNGYYDGKLMKFQSLDQNWNNGGWRKAEVAHKVVHNYENDMIFIRPFKKA

SEQ ID NO: 40346 - protein, 291 aa, Staphylococcus aureus
  subsp. aureus MSHR1132
MKKIEAWLSKRGLKNKRTLIVVIAFILFIIFLFLLLNSNSEDSGNITITENAELRTGPNAAYPVIYKVEKGDHFKKIGKVGKWIEVEDASGNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYISIHNDALESSNANGMTVYWYHENQRALADTLDATIQKKGLLSNRGSRQENYQVLRQTKVPAVLLELGYISNPTDETMIKDQLHRQILEQAIVDGLKFYFSA

SEQ ID NO: 40347 - protein, 895 aa, Staphylococcus aureus
  subsp. aureus MSHR1132
MNKHQPKLRSFYSIRKSTLGVASVIVSTLFLITSHNHAQAAENTTTENKVSENQNTATTTPSQPQDNSNQTQTAGQTSNSAKTYPAPDVSLKDAIKDPALVDKEHDIGPKEQVDFQLLKKNNETQYYHFFSIKNPADVYYTKKKAEVELDINTASTWKKFEVYENDKKLPVTLVSYSPEPEDHAYIRFPVTDGTQELKIVSSTQIDGEKEVNYDYTKLLFAKPIYNDPSLVLSDTDNTTPTNNQTNSDANNQANANSSGQNNTSINNTQNQPQASADTSQPVQPESSIHNDQTTNNQDNETNQNANTTDSTNNSSHQANDSNNQSSNDQQYPPADESLQDAIKNPAIIDKELTYDNWRPIDFQMKNKKGERQFYHYASTVEPAKVIFTKTQPEIELGLKTASTWKKFEVYEGDKKLPVELVSYDSDKDYAYIRFPVSNGTKEVKIVSSIEYGENTHEDFDYTLMVFEHPITNNPDDYLDEETYNVQKLLEPYHKAKTLERQVYELEKLQDKLPEKYKQEYKEKLDQTKVELDKQVKSAIIEFEKVTPTNDQLTDIQEANFIVFESEENSESVMDGFVEHPFYTAMLNGQKYVVMKTKDDSYWKDLIVEGKRVITVSKDPAKNSRTLIFPYVPDKSVYNAIVKVVVPNIGYEGQYHVRIINQDIKTKDDVNSQNNQVDSPTDQVVKDDMSTATKPAINNKVAESQSDATVKEDNKEENIHTVKVMDSSIDKDSNHNDNSSLNIVNNNKFDKYDLKEMETKIDKDVDISENKNALNSTGKEPMGDKDKLADKNELKAIHVNHFTEKVEHNNAGTGTGLMNAVKNGTSKHSQNDVQNVTDKMTNVHKVSNASAKDNNHIKSKMLPKTGRTASSQSLWGIYMLLGMLALFIPKSRKETK

SEQ ID NO: 40348 - protein, 2189 aa, Staphylococcus aureus
  subsp. aureus MSHR1132
MNLLKKNKYSIRKYKVGIFSTLIGTVLLLSNPNAAQALTTDANAQNLSNQNTPTNNQNPNINQGVSTSAQNTTNNTQNTTSQPVNTNTSTNQTLSNHNNVGAANQVAPTPTQPNTISAGNSNNSNATSTADRANNVDASNVAPNTSTLNVSNNTTENGSDHHLTLKEIQDDVRHSSDKPELVAVTEQPSNRPKKRSRRAAPADPNAAPADPATAAAGNGTAPAGNTATYTPTTDPNANNAGQNAPNEVLSFDDNGITPSTNRSVPTVTVVDNLPGFTLVNGGKVGVLSHAMVRTSMFDSADAKNYQAQGNVIALGRIRGNDINDHGDFNGIEKTLTVNPNSELIFEFNTMTTKNAQGATNVIIKNADDDSVLAEKIIAGGPLWRLFKVPDNVRHLKIQFAPKNEAITDARGIYQLRDGYRYYDFVDSIGLRSGSHIYVERHTMDPTATNNKEFTVTTSLKNNGNFGASMNTDDFVYKIQLPEGVEYVNNSLTKDFPSSNSGVDLNNFNVNYDAANRVITIKSTGASGNTPARLMPDKILDLRYKLRVNNVPTPRTVTFNDTLTYKTYSQDFINTPPESYTVSTDPYTIDIIMNKDALQAEVDRRIQQADYTFASLDIFNNLKRRAQSILDENRNNVPLNQRVSQADIDSLTNQMQHTLIRSADAENAVNRKVDQMEDLVNQNDELTDEEKQAAIQVIEEHKNEIIGDIGDQKTDDGVTRIKDQGIETLSRDTATPVVKPNAKQAIRDKATQQRAIINATPDATEDEIQDALNQLTTDETDAVDNVTNATTNQDVESAKNNGVNTIGAVVPQVTHKQAARDAINQATATKRQQINENREATQEEKNAALNELTQATNHALEQINQATTNADVDNAKADGLNAINPVAPVTVVKQAARDAVFHDAQQRIAEINANPDATQEERQAAIDKVNQAVAAANTQILNANTNSDVEQVKNAAIQGIQAIEPSTQIKTDAKNAIDQSAEAQHNIIFNNNDATYEEQQAAQQLLDEAVKTGKQNVNAADTNQEVKQAKDQAVRDITVIQPATQVKTDARNAVNEKAREAITNINATPGATREEKQEAVDRVNTILNRALADIGITSTTAMVNGIRDDAINQIGAVQPHVTKKQEATGILNDLATAKKQQINQNTNATTEEKQVALNQVDQELANAINNINQADTNAEVAQAQQSGSQALNAIQPNIVKKPEAIAQINQHYNAKLAQINQTPDATDDEKNEAISTLNQEKQQALENIKQANTHAEVDQAAAMAENNIDAVQVNVVKKQEARDKINAEATKRIEVVNQTPNATDEEKQAAMNKINQLKDQALNQINQDRTNDQVDATTNQMTTSIDNVQADVVAKPKAIADIEKAFKEKQQQIDSSVDSTDNEKEVAAQALAREKEKALAAIDQAQTNNQVNQAATNGLSSIKTIQPETRVKPAAREQINQKANELRAQINQDKEATEEERQSALNKINELVNQAMSDISNDRTDQQVNDTTTQALDNIMQVNPEHIVRAAAREAVKQQYEAKKQEIEQAEHATDEEKQAALNQLAKNEQQALRNIDQAVNNNNVKSGESKGIATLKGVEPHIVIKPEAKQAIETSAEKQIESIKDTPNATADEINEANQLINDTLLQGQQQIDNTNQDGAVTDVRNQTIKAIEEIKPKVRRKRAALDNIDQNVNKQTETIQNTLDTTQDERNEAIDALNKVANTIKNDIAQNNTNAEVDQTETEGQENIKVILPKVQVKPEARQAISAKAEAQNKLIDQSDLSTEEERLEAKHLVEQALNQAIDQINHADQTVQVNQHNLNAQNIISQIKPATTVKTKALQQIQDIATNKINLIKSNNEATDEEQNAAIAEVEQALNKAKQQIASAVTNADVAYLLHDGKNEIREIEPVINRKATAREQLTTLLNDKKQAIESNVQATVEERNSVLAELQKIYDAAILQIDHDRSNAQVDKSTSLNLQTIQDIDVHPAKKPNAEITINQEVARVTSLVQNYRNVSDRNKSDALKAIDSLKLQMEEALKSAKTNADVDAVLKQFNISLGNIEAVITEKENGLNNIEKVAQQTYEKFKAIATPDQLAKVKMLIEQYVADGTRMIDVDATLNDIKQHTQFIINEILAIKLPAEATVVSSKVSKSVPKVSELGKKECKREARKDKKELPNTGSNGTDLPIKEIALIGGAALLARRRNKQEKQS

SEQ ID NO: 40349 - protein, 331 aa, Staphylococcus aureus
  subsp. aureus MSHR1132
MSNQFKSEEEKRQWEQFQAFQKHQNQQNQQFRQKKSRKGWFWGCGGCLVLFILIIIGISACTAGITGNLGGNNSKETNKTHKIGETVKNGDLEVTVNSVETMKSVGPSIAPTNAKGTFVVADVTIKNKGKEALTIDSSMFKLKTGDKTFEADNTGSMSANQNDNGSIENSFFLQRINPDSTAQGKIVFDVSENIANAKDKKLEVISSLFSVKKITFDLSDAKKTSKAKKENNDEDVATASSNNDNVNYEASATTPSTPSSANNDSEENEQSSKDEDKQDASQSDKSSVEKSESKSEPATAESAPQSKPVTSEAPPSQNNHNEDSMYDATTE

SEQ ID NO: 40350 - protein, 218 aa, Staphylococcus aureus
  subsp. aureus MSHR1132
LKDKSYDLVLKAAGNINSGYKKPYPNDYKYSQFYWGAKYNVSISSQPNDSVNVVDYAPKNQNEEFRVQQTLGYSYGGDINISNGLSGGGNGSKSFSETINYKKESRTTIDSKTNHKSIGWGVEAHKIMNNGWGPFGRDSYDQTYANELFLGGRQSSSNAGQKFLPTDRMPILSRGNFNPEFIGVLSHKQNDAKKSKIKVTYQREMVFNRSEILKFIST

SEQ ID NO: 40351 - protein, 258 aa, Staphylococcus aureus
  subsp. aureus MSHR1132
MKKLSTVIIILILEIVLYNIKYANAQPDPKLDELNKVSDYKINKGTMGNVMNLYMSPPVEGRGVVNSRQFLSHDLIFPIEYKSYNEVKTELKNTELANNYKGKKVDIFGVPYFYTCIIPKHEPDINQNFGGCCMYGGLTLNSSENERDKLITVQVTIDNRQSLGFTITTNKNMVTIQELDYKARHWLTKEKKLYEFDGSAFESGYIKFTEKNKASIWFDLFPKKELVPFVPYKFLNIYGDNKVVDSKSIKMEVFLNTH

SEQ ID NO: 40352 - protein, 251 aa, Staphylococcus aureus
  subsp. aureus MSHR1132
MRLFYIALIIITLLCLINNNYVNADVDKNDLKKKSDLDSSKLFNLTSYYTDITWQLEKSNVISSDQLLNNTIIFKNIVIAELNTSSLKVEFNSLDLANQYKGSNVDIFGLYYGNKCVGLHGEKTSCLYGGVTIHDGNQLDEERVIGVNVFKDDAQQEGFVIKTKKAKVTVQELDTKVRFKLENLYKIYNKDTGNIQKGCIFFHSHNNQDHSFYYDLYNIKGSVGAEFFQFYGDNRTVNSSNYHIDVFLYKD

SEQ ID NO: 40353 - protein, 256 aa, Staphylococcus aureus
  subsp. aureus MSHR1132
MKLFAFLFICVKSCSLLFMLNDNPKPEQLNKASEFTGLMDNMRYLYDDKHVSETNIKAQEKFLQHDLLFKINGSKILKTEFNNKSLSDKYKNKNVDLFGTNYYNQCYFSADNMELNDGILIGKTCMYGGVTEHDGNQIDKNNSTDNSHNILIKVYENERNSLSFDIPTNKKNITAQEIDYKVRNYLLKHKDLYEFNSSPYETGYIKFIEGNGNTFWYDMMPESGEKFYPTKYLLIYNDNKTVDSQSVNVEVHLTKK

SEQ ID NO: 40354 - protein, 242 aa, Staphylococcus aureus
  subsp. aureus MSHR1132
MKKFKYSFIVVFILFFNVDDLSYAQGDIGVGNLRNFYTKYDYIDLKGVTDKNLPIANQLEFSTGTNDLISESNNWDEISKFKGKKLDIFGIDYNGPCKSKYMYGGATLSGQYLNSARKIPINLWVNGKHKTISTDKIATNKKLVTAQEIDVKLRRYLQEEYNIYGHNNTGKGKEYGYKSKFYSGFNKGKVLFHLNDEKSFSYDLFYTGDGVPVSFLKIYEDNKIIESEKFHLDVEISYVDSN

SEQ ID NO: 40355 - protein, 239 aa, Staphylococcus aureus
  subsp. aureus MSHR1132
MKRILIIVVLLFCYSQNHIATADVGVLNLRNYYGSYPIEDHQNINPDNNRLSHQLVFSMDNSTVTAEFKNVDDVKKFKNRAVDVYGLSYSGYCLKNKYMYGGVTLAGDYLEKSKYIPINLWVNSEHQTISTEKVSTNKKIVTAQEIDTKLRRYLQEEYNIYGFNDTNKGRNYGTKSKFSSGFNTGKISFHLNDGSSFSYDLFDTGTGQAESFLKIYNDNKTVETDKFHLDVEISYKDES

SEQ ID NO: 40356 - protein, 254 aa, Staphylococcus aureus
  subsp. aureus MSHR1132
MLNVLLLIINLIAICSVNNAYANEEKPKIEDLCKKSSVDPIALHNIEKDYVNNRFTIDKSPVSTTEKFLDFDLLFKNFTWLDGKSAEFKDLKVEFSSSEISKEYFGKTVDIYGVYYKAHCHGEHQVKTACTYGGITSHENNKLSEPKNIGVAVYKDNVNVNTFIVTTDKKKVTAQELDIKVRTKLNNEYKLYDRMTSDVQKGYIKFHSHSEQKESFYYDLFYIKGNLPDQYLQIYNDNKTIDSSDYHIDVYLFT

SEQ ID NO: 40357 - protein, 338 aa, Staphylococcus aureus
  subsp. aureus MSHR1132
MIKQICKNITICSLALSTTLTVFPATSFAKIKSEITQVSEQNIDGNTKMFTRTATTSDSQKKISQSLQFNFLTEPNYDKETVFIKAKGTIGSGLKILDPNGYWNSTLRWPGSYSVSIQNVDNNTNTKVTDFAPKNQDETREVKYTYGYKTGGDFSISPGGITGNITKERNYSETISYQQPSYRTLIDQPATNKGVGWKVEAHLINNMGHDHTRQLTNDSDNRVGSEIFTLTRNGNLWAKDNFTPKNKMPVTVSEGFNPEFLAVMSHDKKDKGKSKFVVHYKRTMDDFKIDWMRHGFWGYWTGKNHVDQKEEKLSALYEVDWKTHDVKFIKALDDKEKK

SEQ ID NO: 40358 - protein, 350 aa, Staphylococcus aureus
  subsp. aureus MSHR1132
MKNKKRVLLASSLSCALLLLSAATTQANSAHKDSQDQNKKEHVDKAQQKDKQDSTKKGKNVAAPDDVGKNGKVTKRTESEYDEKTNILQNLEFNFIDDPTYDKDVLLVKKQGSIHSNLKFESHKEEKNSTWLKYPSEYHVDFQVKRNPKTEILDQLPKNKISTAKVDSTFSYTLGGKFDSIKGIGRNSSNSYSQTISYNQQNYDTIASGKNNNWHVHWSVIANDLKYGGEVKNRNDEFLFYRNTRTSSVDNPESSFAAKYRYPALVRSGFNPEFLTYLSNEKSNEKTQFEVTYTRNQDILKNSPGLHYAPPILEKNKVGHRFIVTYEVDWKNKTVKVVDKYSDDQPFREG

SEQ ID NO: 40359 - protein, 44 aa, Staphylococcus aureus; identical to SEQ ID NO: 30451
  subsp. aureus MSHR1132

SEQ ID NO: 40360 - protein, 230 aa, Staphylococcus aureus
  subsp. aureus MSHR1132
MKKTLLASSLAVGLGIVAGNAGHEAHASEADLNKASLAQMAQSNDQTLNQKPIEAGAYNYTFDYEGFTYHFESDGTHFAWSYHATGANEATVSAQAPTNGVAPSTTQANPTQSQEVAAPQNAQTQQPQASTSNNSQMTATPTESKASEGSSVNVNDHLKQIAQRESGGNIHAVNPTSGAAGKYQFLQSTWDSVAPAKYKGVSPANAPESVQDAAAVKLYNTGGAGHWVTA

SEQ ID NO: 40361 - protein, 2433 aa, Staphylococcus aureus
  subsp. aureus MSHR1132
MNLFRQQKFSIRKFNVGIFSALIATVTFISTNPTASAAEQNQPAQNQPAQPADANAQPNANAGTPGAQANPAAQPAGTPANKPQPAANQGGQADPNAQPAGQGNQVDANNAAQAQPGNQVGQGNNQTAPANNAAPANQAQPANAAAPAGQPAAAQPAPVASNTQTQDPNANNTGEGSINTTLTFDDPAIKTDENRQDPTVTVTDHVNGYTLINNGKVGFVNSELRRSDMFDKNSPQNYQAKGNVAALGRVNANDSTDHGDFNGISKTVNVKPDSELIINFTTMQTNSKQGATNLVIKDAKKNTELATVNVAKTGTAHLFKVPTDADRLELQFIPDNTAVADASRITTNKDGYKYYSFIDNVGLFSGSHLYVKNRDLAPKATNNKEYTINTEIGNNGNFGASLKADQFKYEVTLPQGVTYVNDSLSTTFPDGNEDSTVLKNMTVNYDQNANKLTFTSQGVTTARGTHTKEVLFPDKSLKLSYKVNVANIDTPKNIDFNEKLTYRTASDAVINNAQPEVTLIADPFSVAVEMNKDALQQQVNVQIDDSHYTTASIAEYNKLKQQADTILNEDANHVETANRASQADIDGLVTKLQAALIDDQAAIAELDAKAQEKITAAQQNTKVTRDEITAFVTKVNNDKNNAIAEINKQTTAQGVTTEKDNGIAVLEQDVITPTTKPQAKQEIIQAVTTRKQQIKKSTASLQDEKDVANNKIGQIETKAIKDIDAATTNEQVEAIKTKAINDINQTAPTTSAKAAALDEYYEVVQAQIDEAPLNPDTTNEEVAEAIERINAAKEAGVKAIEATTTAQDLERVKNEEIFKIENLTDSTETKMNAYKEVKQAAAAKNAQNAAVTNATDEEVAEAKQAVDTAQKEGLHDIKVVKSKQEVADTKAKVLDKINAIQTQVRVKPEATAAVENAYNTRKQEIQNSNASTTEEKEAAYTQLDAKKQEALTNIDTENTNNGVATAKDNGISAINQIQAATTKKTEAKAEIAQKASERKTAIEAMNASTTEEQQAAKDKVDEAVVTANADIDNAAANTDVDNVKTTNEGTIAAITPDANVKPAAKQAIAEKVQAQETAIDANNGATTEEKAAAKQLVQTEKTTADTAIDDAHSNADVEAAKNAEIAKIEAIQPATTTKDDAKQAIATKANERKTAIAQTQDITAEEIAAANTDVDNAVTQANSNIEAANSQNDVDQAKTNGETSIDQVTPTVNKKATARNEITTILNNKLQAIQATADATDEEKQDAETEANTENAKANQAITAANTNAEVDEAKATAEAAINAVTPKVMKKQAAKDEIDQLQAAQTTVINNDQNATNEEKEAAIQQLAQAVTDAKNNITAANDNNGVDAAKDAGKNSIQSTQPATAVKSNAKNDVDQAVATQNQAIDNTTGATTEEKNAAKDLVTKAKEKAYQDILNAQTTNEVTQIKDQAVTDIQGITADTTIKDVAKGELTTKANDQKALIAQSADATTEEKDQANQQVDARLTQGMQNIENAQSIDDVNTAKDAGIQAIEPIQASTDVKTNARAELLNEMQNKINDILNDNDTTNEEKEKGIGPVRNAYEEGLNNINAASTTVDVNNAKDLAVNKVQHIQATPVKKPAGKTELEQAATERKQQIEQTPNASQQEINDAKQEVDNELNQAKTNVDQSSTDGYVDAAVKGGKAKINAVKTFSEYKKDSLAKIEDAYNAKVSEADNSNASTASEIAEAKQKLAEFKQTAEQNINQATSKDDIEIQIHNDLDNINNYVIPSAKKESATNELYAYADQKRNNISADTNATQDEKQAAINKVNQTVESALESINDGVENSDVDDALAQGKAAIDAVQVEATVKPKAIQVIDTKAEETKDSIDHSDQLTTEEKSEALATIKQITDQAKQGINDATTTAEVEKAKAQGLEAFDNIQIDSTEKQKAIEELETALDQIEAGVNVDADATTEEKEAFTNALEDILSKATEDISDQTTNAEIATVKNSALEELKAQRINPVVKKNALEAIREVVNKQIEIIKNADADASAKEIARTDLGRYFDRFADNLDKTQTNTEVAELQNVTIPAIEAIVPQNDPNANATPENTGQPNSTAATTNENVDAPSTTPSNSSMSTDESTTAPSAINSSSDNTTTNSNGNVNASTSTDNGTTDKPSPKTNSATPTEGTTNNNTTAATSGNDAPSNNSSSSTAPTATENTVASSATEGNMEPSTNDTNQNADVNNNADSQPANGKVAQPKSEATHKSEKDGKDSTNQSMVESTNETLPSADITEPKAPSVTSKDKEGSMSEQSEAGQSKSDTKVASNETDETTGKVDTDVSNNSTASKSVDAKDNMTSKDASQKDNMTTAGATDKATQNDNTKASVASVSNENNSTNQEMTETRKSNIDKYNAMSVQQNKDTKAEPKTNQKAKALPDTGMSHNDDLPYAELALGAGMAFLIRRFTKKDRQTEE

SEQ ID NO: 40362 - protein, 811 aa, Staphylococcus aureus
  subsp. aureus MSHR1132
MTYKMKKWQKLTTITLLMAGVITLNDGEFRSVDKHHIAVADTNAQTPDYEKLKKTWLDVNYGYDQYDENNAAMKKKFEATEKEAKKLLDEIKTDTNRTYLWSGAENLDTNSSHMTKTYRNIEKIAEAMRHKNTSLKTDENKLKIKDALDWMHKNVYGKNPSQKVDDLTKNRKGQTTPKNNSLNWWDYEIGTPRALTNTLILLNDQFSNEEKKKYTAPIKTFAPDSDKILSSVGKAEPAKGGNLVDISKVKLLESIIEEDKDMMKKSIDSFNTVFTYVQSNATGKERNGFYKDGSYIDHQDVPYTGAYGVVLLEGISQMMPMIKETPFKDSNQNDTTLKSWIDEGFMPLIYKGEMMDLSRGRAISRENETSHSASATVMKSLLRLSDTMDDSTKTKYKQIVKTSVESDSSYKQTDYLNSYSDIDKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTVVKKPSKTFVGGIKFDDQHASIGMDFENQDKTLTAKKSYFILNDKIVFLGTGIKSTDSSKNPVTTIENRKANGYTLFTDDKQTTASNINDQETNSVFLESTNKPKNNIGYHFLNKSKISIKKETHTGNWKEINKSQKDTQKTDEYYEVTQKHSDKDDKYGYVLYPGISKDVFNTKKDLVTIIQQGDDFHVVKDNESVWAGVNYSNSTQTFDINNTKVEVKAKGMFVLKKKDDNTYECSFYNPESTNTASDIESKISMNGYSITNKNTSTSNESGVHFELTK

SEQ ID NO: 40363 - protein, 141 aa, Staphylococcus aureus
  subsp. aureus MSHR1132
MKLKSFVTATLALGLLSTVGAAFPNHEASADSNNGYKELTMDGKHTVPYTISVDGITALHRTYFVFPENKNVLYQEIDSKVKNELASQRGVTTEKINNAQTATYTLTLNDGNKKVVNLKKNDDAKNSIDPSTIKQIQIVVK

SEQ ID NO: 40364 - protein, 691 aa, Staphylococcus aureus
  subsp. aureus MSHR1132
MIREQERRKYSIRKYSIGVVSVLAATVFVVSTHDAKAAEKMPTSQSGTQQEKLNQSGEHRNIHQLQQDEQSLRQLNDAHKIDSESQIGRQANDALQSSKQQPTKDGKTDKSQNNNKVTQNANQQNVKQLSKDNSNKNTKNQDAIKQNDSRAEQDNLKSNADAKEVDKSQPSVQTQISTTQDDKATSASTTPSSKEKTTTASEVQDASTNKNVNQQDTHPVSQQIKDAKQDDAVRQRQDKPLVNDLSKHNNTQNSPTIPTDKNTDNQRLIKDALLAPKTRATTKVATADAKKIHPLKANQVQPLNKYPVVFVHGFLGLVGDNAPALYPNYWGGNKFKVIEELKKQGYNVHQASVGAFSSNHDRAVELYYYIKGGRVDYGAAHAAKYGHERYGKTYKGIMPDWEPGKKVHLVGHSMGGQTIRLMEEFLRNGNQEEIAYHKAHGGEISPLFVGGKNNMVASITTLGTPHNGSQAADKFGNTETVRKIMYALNRIAGNKYSNIDLGLTQWGFKQLPNESYIDYMKRVGNSKIWTTTDNAAYDLTLDGSAKLNAMTSMNPNITYMTYTGVSSHTGPLGYENPDIGTFFLMDATSRIIGHDAREEWRKNDGVVPVISSLHPSNQPFVNVTSEEPATRRGIWQVKPILQGWDHVDFIGIDFADFKRKGAELANFYTGIINDLLRVEATDEKGAQLKAS

SEQ ID NO: 40365 - protein, 203 aa, Staphylococcus aureus
  subsp. aureus MSHR1132
MFKKHHSKNSIVLKSILSLGIIYSGIFGINSKADASIQDSSSVHDKQFQKVEEVPNNSEKALVKKLYDRYSQNTINGKSNKSRNWVYSERPLNENQVRIHLEGTYTVAGRVYTPKRNITLNKEVVTLKELDHIVRFAHISYGLYMGEHLPKGNIVINTKDGGKYTLESHKELQKDRENVEINTADIKNVTFELVKSVNDIEQA

SEQ ID NO: 40366 - protein, 226 aa, Staphylococcus aureus
  subsp. aureus MSHR1132
MKFTTIAKASLAIGILATGAMTSTSQSAHAKSAVTQQSESDLKLYYNGPSFEHKKVTGFKYSDEKGSFFEFIDKGQFNKISLLGSDKDKFKEGKNSNLDVYVVREGAGRQADNYSIGGVTKTNSLPYFDQINSPILEIKKGSEDLYKGYHLIFKEDISLKELDFKLRKQLISQSGLYSNGLKQGQITITMNDGTTHKIDLSKKLEKERMGDSIVGTQIQKIQIEIR

SEQ ID NO: 40367 - protein, 227 aa, Staphylococcus aureus
  subsp. aureus MSHR1132
MKMKSIAKVSLALSILATGVQTTTAQPANAVEISQNSKKLKSYYTQSSVEYKNTTGYISSIQPNIKFMNVIQDNTVNNIALVGKDNQHYHAGVHRNLNIFYVAEDKHFNGGKYSIGGITKANDKAVDQIAEVRVVKEDHRGEYEYDFFPFKVDKEDMSLKEIDFKVRKYLIENYGLYGEMSSGRIIVQTKNYGRYTFELDKKLQEDRMSDIIDATSIERIEVVVKKA

SEQ ID NO: 40368 - protein, 286 aa, Staphylococcus aureus
  subsp. aureus MSHR1132
MKMRTITKASLALGFLTTGIITTTTQSANASTPPSVKTEQVPKTNAEKALPGKIEQVPKPNVEKASPLNESTTPSTKVETSQPQSTNPTPPSEINPKYKGLRSYYTKPSLEFENQFGFMLKPWTTVRFMNIIPERFIYKIALVGKDDKKYKNGPYDHIDAFIVLEDNKYGLKKYSVGGITKTNSKKVDRKVELNITKEDNKVAISRDVSEYKITKEEISLKELDFKLRKQLIEQHNLYGNIGSGTIVIKMKNDGKYTFELHKKLQEHRMADVIDGTNIDKIEVNIK

SEQ ID NO: 40369 - protein, 234 aa, Staphylococcus aureus
  subsp. aureus MSHR1132
MKMTAIAKASLALSILATGVITSTSQTVNASEHESKYENVTKDVFDLRDYYSGASNVLKNVIGYHYSKGGRHYLVIDKNRKFTRVQVFGKDIERFKARKNPGLDIFVVKESQNKNGTVYSYGGVTKRNQGTYYDYISAPRFLIKNEQGKSTLVYSRVHYIYKEEISLKELDFTLRQYLIRNFDLYKKFPEDSKIKVIMKDGGYYTFELNKKLQTNRMSDVIDGRNIEKIEANIR

SEQ ID NO: 40370 - protein, 231 aa, Staphylococcus aureus
  subsp. aureus MSHR1132
MKLKTLAKATLALGLLATGVITSEGQAVQAKEKQERVQHLYDIRDLHRYYSSDSFEYSNISGKVENYNGSNVVRFNQKDQKHQLFLLGKDKEQYKEGIEGKDVFVVQELIDPNGRLSTVGGVTKKNNKTSETKIPLLVNKVYGGNLDASIDSFLTQKEEVSLKELDFKLRQQLVEKYGLYQGTSKYGKITINLKDEKREVIDLSDKLQFERMGDVLNSKDISGISVTINQI

SEQ ID NO: 40371 - protein, 227 aa, Staphylococcus aureus
  subsp. aureus MSHR1132
MEMKTLAKATLALGLLTTGTLTTETHSGHAKQTQKSVNKHDKEALHRYYTGNFKEMKNINALRHGKNNLRFKYRGMKTQVLLPGDEYRKYQQRRHTGLDVFFVQERRDKHDISYTVGGVTKTNKTSGFVSKPMLNVTKEKGEDAFVKGYPYDIKKEEISLKELDFKLRKHLIEKYGLYKTTLKDGRAKISLKDGSFYNLNLRYKLDFKYMGEVIDSKQIKNIEVNLK

SEQ ID NO: 40372 - protein, 230 aa, Staphylococcus aureus
  subsp. aureus MSHR1132
MKLKNIAKASLALGILTTGMITTTAQPVKASESSRLSIITKNTKDLKDYYNGPTFSHKNISGYKEEDKVIFTPNMQQVSVKLTGKENLEFNDEDVVSNVDVFVVRENSDKSGNTFSIGGITKTNSQDNIDNVKSVNMQITKKISSNAETVTSSYYSIGKENISLKELDFKLRKHLIDKHDLYKTEPKDSKIRITMKDGGYYTFELNKKLQEHRMGDVINGRNIEKIEVNL

SEQ ID NO: 40373 - protein, 320 aa, Staphylococcus aureus
  subsp. aureus MSHR1132
MKEKINRKKVISMVKNKILAATLSIGLLAPLANPFIETSKAENNIEDIGKDAEIIKRTQDVSSQRWGVTQNIQFDFVKDKKYNKDALVVKMQGFIKSRTTYSELKKYPYIKRMTWPFQYNIGLKTKDPNVDLINYLPKNKVETTDVSQKLGYNIGGSFQSAPSIGGSGSFNYSKTISYTQKSYVTEVDSQNSKSVKWGVKANSFATDSGQVSAYDQYLFAQDPTGPSARNFFVPDNQLPPLIQSGFNPSFITALSHERGKGDTSEFEITYGRNLDATYAYISRDRLAVDRKHNAFPNRNFTVKYEVNWKTHEVKVKSVSR

SEQ ID NO: 40374 - protein, 312 aa, Staphylococcus aureus
  subsp. aureus MSHR1132
MIKNKILATTLSASLIVPLATPIFENAKAANDTEDIGKGDVEIIKRTEDKTSNKWGVTQNIQFDFVKDKKYNKDALILKMQGFISSRTAYYNYKDTNHIKSMRWPFQYNIGLKTNDPNVSLINYLPKNKVETTNVSQTLGYNIGGNFKTAPSIGGSGSFNYSKSISYTQQNYVSEVEHQNSKSILWGVKANSFATPTGQKSAFDKDLFVGYKPHSPNPRDYFLPDNDLPPLVQSGFNPSFIATVSHEKGSGDTSEFEITYGRNMDVTHAIKRATHYSNSYLDGHRIHNAFLNRNYTVKYEVNWKTHEIKVKG

SEQ ID NO: 40375 - protein, 325 aa, Staphylococcus aureus
  subsp. aureus MSHR1132
MKMNKLVKSSVITSMALLLLSNSADAVEKITPVSEKKVDSRVTLYKTTATSDSDKYRISQILTFNFIKDKNYDKDTLVLKAAGNINSGYTPPNPKDYDFSKLYWGAKYNVSISSESNDSVNVVDYAPKNQNEEFQVQNTLGYTFGGDISISNGISGGLNGNTAFSETITYKQESYRTTLSRNTNYKNVGWGVEAHKIMNNGWGPYGRDSFDPTYGNEIFLSGRQSSSNAGQNFIAQHQMPLLSRSNFNPEFLSVLSHKQNGAKKSKIKVTYQREMDLYQIRWNGFFWSGANYKNFKTRTFTSIYEVDWENHTVKLLDKKETEVNK

SEQ ID NO: 40376 - protein, 1050 aa, Staphylococcus aureus
  subsp. aureus MSHR1132
MNNKKTTTTRNGMMPSKLNKFSIRKYTVGTASILVGTTLIFGLSNHEAKAAESTSEEINKAKNEATGTNEKQVSEKVDSSQQNGNVQTKTSEQPKVTMSNDTSVKKTSGNTQSPQIATANQSTTQTNNKVTTNDKAATTYSNESSKSNLTQAKDVSTTPKTTTIKPRTLNRMAVNTVAAPQTGTNVNDKVHFSNIDIAIDKGHLNKDTGNTEFWATSSDVLKLKANYTIDDSVKEGDTFTFKYGQYFRPGSVRLPSQTQNLYNAQGNIIAKGIYDSATNTTTYTFTNYVDQYTNVSGSIEQVSFAKRENATTDKATYKMEVTLGNDSYSKDVIVDYGNKKTQPLISSTNYINNEDLSRNMTAYVNQPKNTYTKETFVTNLTGYKFNPNAKNFKIYEVTDQNQFVDSFTPDTSKLKDVTDQFDIKYSNDNKTATVDLMKGQSSSNKQYIIQQVAYPDNTSTDNGKIDYILDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPTGYTPTTANAGTDDAVDSDGLTTTGVIKDADNMTLDSGFYKTPKYSLGDYVWYDSNKDGKQDPTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPAKPMSTVKDHHNKAKALPETGSEDNGTNNATLFGGLFAALGSLLLFGRRKKQNK

SEQ ID NO: 40377 - protein, 1425 aa, Staphylococcus aureus
  subsp. aureus MSHR1132
MLNRENKTAMTRKGMVSNRLNKFSIRKYTVGTASILVGTTLIFGLGNQEAKAAESTNKELNEATTSASDNQSSSKVDNQQLNQEENTKNEYQKEMVSSQGTEKTSNENKTQSLEKESVQSSTGNKAEVSTAKSDEQALPKSTNISSNTKQTISNQEVSQSDFQEKKSEVNVQSTNEENKDTEVKTAPTTLNVKSDAIKSNTETLVDNNSNSNNENNADIILPKSTAPKRLNTRMRMAAVQPSSADSKNVNDLITSTTSLTVVDADKNNKIVPAQDYLSLKSQISVDDKVKSGDYFTIKYSDTVQVYGLNPEDIKNIGDIKDPNNGETIATAKHDTVNNLITYTFTDYVDRFNSVKMGINYSIYMDADTIPVSKNDVEFNVTIGNDTTKTTANIQYPDYVTRDNNSIGSAFTETVSHAGNAEDPGYYKQTVYVNPSEKSLTNAKLKVEAYHKDYPDNVGQINKDVTKIKIYQAPKDYILNKGYDVNTNQLIDVTEQFKDKITYGANDSVNVDFGNINNSYVVVVDTKFEYTTSESPTLVQMATLSSDGNKSVSTGNALGFTNNQSGGAGQEVYKIGNYVWEDTNKNGIQELGEVGVKGVTVVAYDNKTNKEVGRTITDEKGGYLIPNLPNGDYRVEFSNIPQGYEVTPSKQGNNEELDSNGVSSVITVNGKDNLSADLGIYKPKYNLGDYVWEDTNKNGIQDQDEKGISGVTVTLKDENDKILKTVTTDADGKYKFTDLENGNYKVEFTTPEGYTPTSQNTGGNDTVDSNGLTTTGVINGADNMTLDSGFYKTPKYNLGNYVWEDTNKDGKQDSTEKGISGVTVTLKNENGEVLQTTKTDKDGKYQFTGLENGTYKVEFETPTGYTPTQVGSGSDESIDSNGTSTTGIIKDKDNDTIDSGFYKPTYNLGDYVWEDTNKNGIQDQDEKGISGVTVTLKDENDKILKTVKTDADGKYQFTDLNNGTYKVEFETPAGYTPTTVTSGNDTEKDSNGLTTTGVIKDADNMTLDSGFYKTPKYSLGDYVWYDSNKDGKQDPTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSEVGKHTPAKPMSTVKEHHNKAKALPETGSEDNGSNNATLFGGLFAALGSLLLFGRRKKQNK

SEQ ID NO: 40378 - protein, 1181 aa, Staphylococcus aureus
  subsp. aureus MSHR1132
MINRDNKKAITKKGMISNRLNKFSIRKYTVGTASILVGTTLIFGLGNQEAKAAENTSTENAKQDEASTSADKEVMSNTENNSTTEKNTTDSIKEETNTDSQTEVKEEPKTSTTQQQQNNTTTSTETKPQTNENNNVKPSTDKTATEDTSVILEEKTAPNNKNNDVTTNQSTSETQPTQQTPQEPTNNETSQPQSTPSKVDNQVTDATNPKQTVNVSKEDLKNDPEKLKELVRSENNTDHSTKPVATAPTSVAPKRLNAKMRFAVAQPAAVASNNVNDLITVTKQTITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGANMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDSGFYKEPKYNLGDYVWEDTNKDGIQDANEPGIKDVKVTLKDSTGKIIGTTTTDASGKYKFTDLDNGNYTVEFETPAGYTPTLKNTTAEDKDSNGLTTTGVIKDADNWTLDSGFYKTPKYSLGDYVWYDSNKDGKQDPTEKGIKDVTVTLQNEKGEVIGTTKTDENGKYRFDNLDSGKYKVIFEKPAGLTQTGTNTTEDDKDADGGEVDVTITDHDDFTLDNGYYEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDAGKHTPAKPMSTVKDHHNKAKALPETGSEDNGTNNATLFGGLFAALGSLLLFGRRKKQDK

SEQ ID NO: 40379 - protein, 1627 aa, Staphylococcus aureus
  subsp. aureus MSHR1132
MREKKGPVNKRVDFLSNKLNKYSIRKFTVGTASILIGSLMFLGTQQEAEAAENNSEKPTTLKDNVQSKEVKTEEVTKKDTVPQGIETKSEVTSNKETIEHGPSVKAEGISKKEDTPKEVGNVGEVQSKSLVAHNAETPKVRKARSVDKGSFDITRDSKNVVKSTPITIQGKEHFEGYGSVDIQSNPEDLKVSEVTRFNNKSIGRNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGTDGATSKVGANIPTRGKADNSFQYADNSVDTTDGKFHGQLLNNLKLAYNEQSGIMRAEYAGKVWEANITDLGLNKSEAYNFLITSSQRQGTSQGVYANGWMRTDLNNSTFKLTPNLVNKTETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVTKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVTKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVTKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVTKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVTKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVTKHGPKTGTPETKTVEIPFETKREFNPKLQPGEERVKQEGQPGSKTITTPITVNPLTGEKVGEGQPTEEITKQPVDKIVEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPKNPEKPSRPTHPSGPVNPKNPGLSKDRAKPNDPVHSIDKNGKVRKSKIAKESVANQEKKRAELPKTGVESTQKGLIFSSIIGIAGLMLLARRRKN

SEQ ID NO: 40380 - protein, 970 aa, Staphylococcus aureus
  subsp. aureus MSHR1132
MKSNLRYGIRKHKLGAASVFLGTMIVVGMGQDKEAAASEQNSTTVEGNGNSATENKASEQQTTTNNVNTIDETQSYSATSTEQPSKSTQVTTEEAPKTVQAPKVESEIKSQIDLTLEKAADKETTGTQVDSAQQRSASEIKPRMKRAADVSEVAGKEVVEKEVKTTGSDVTNKVTVEAGSEIVGHNQDTNVVNPHNAQRVTLKYKWKFGEDIKQGDYFDFTLSNNVETHGISTLRKVPEIKSATEDKVMAIGEVINERKIRYTFTDYITNKKDLMAELSLNLFIDPTTVTKQGKQKVEVTLGDKTIEKEFNIKYLDGVKDRMGVTVNGRIDTLNKEDGKFSHFAYVKPNNQSLTSVTVTGQVTAGYKQNANNPTVKVYKHIGSDELAESVYAKLDDANKFEDVTNKVNLSYTGDGGYSLNFSDLDNSKEYVIKYEGEYDQNAKDLNFRTHLSGYHKYYPYYPYYSYYPVQLTWNNGVAFYSNNAKGEGKDKPNDPIIERGNPIELDFTSKQPDEKHELTGTIEESNDSKPIDFEYHTAVEGAEGHAEGVVETEEDSIHVDFEESTHENSKHHADVVEYEEDTNPGGGQITTESNLVEFDEESTKGIVTGAVSDHTTVEDTKEYTTESNLIELVDELPEEHGQAQGPIEEITENNHHISHSGLGTENGHGNYGIIEEIEENSHVDIKSELGYEGGQNSGNQSFEEDTEEDKPKYEQGGNIVDIDFDSVPQIQGQNKGDQSFEEDTEEDKPKYEQGGNIIDIDFDSVPHIHGFNKHNEMIEEDTNKDKPSYQFGGHNSVDFEEDTLPKVSGQNKGQQTIEEDTTPPVVPPTPPTPDVPSEPETPTPPTPEVPSEPGKPTPPTPEVPSEPEVPTPPTPEVPTEPGKPVPPAKEEPKKPSKPVEQGKVVTPVIEINEKVKTVTPAKAQQPKQVDQKELPQTGSEESTNKGMFFGGLFSILGLALLRRNKKNNKA

SEQ ID NO: 40381 - protein, 1048 aa, Staphylococcus aureus
  subsp. aureus MSHR1132
MKNSLRYGIRKHKLGAASVFLGTMIVVGMGQDKEAAASEKNTTAVEENGNSTTDNKSSEQQTTTNNVNNIDGTQTYSTTSTEQPSNATQVTSEVAPKAVEAPQNVQTANVETVKEERIKEEAKPQVKETAKPQENNGDQKQVDLTPKKSTQNQVAETQVEVAQPRAAESKPRVTRSADVVEAKDTSDAKMETGTDVTSKVTVTESSIEGHNNTNKVEPHAGQRAVLKYKLKFEDGLKRGDYFDFTLSNNVNTYGVSTARKVPDIKNGSVVMATGKILEDGKIRYTFTNDVEHKVEVTANLEINLFIDPKTFQSNGEEKVTSSLNGSKTEKNLKIEYKNGVGTYYANVNGSIETFDKAKSKFTHVAYVKPLNQFKLGTVTVSGTVTDGSNPNGKNPTVKIYEVSNDGKELPQSVYLDASDTSKYKDVTNEMQSKLTVYKNGNYTLNLDKLDKSYVIHYSGEYLKDANEVNFRTQMFGYPEPRYGYYYNSYQLTWDNGLVLYSNKADGNGKNGQIIQNNDFEYKEDTLTETVTGQYDKNLVTTVEEETDSSTLDIDYHTAIDGEGGYVDGYIETIEETDSSILDIDYHTAVDSEAGHLEGYTESSEESNPIDFEESTHENSKHHADVVEYEEDTNPGGGQITTESNLVEFDEESTKGIVTGAISDHTTVEDTKEYTTESNLIELVDELPEEHGQAQGPIEEITENNHHISHSGLGTENGHGNYGIIEEIEENSHVDIKSELGYEGGQNSGNQSFEEDTEEDKPKYEQGGNIVDIDFDSVPQIQGQNKGDQSFEEDTEEDKPKYEQGGNIIDIDFDSVPHIHGFNKHNEMIEEDTNKDKPSYQFGGHNSVDFEEDTLPKVSGQNKGQQTIEEDTTPPIVPPTPPTPEVPSEPETPTPPAPEVPSEPEKPTPPTPEVPSEPEKPTPPTPDVPSEPEKPTPPTPEVPSEPETPTPPTPEVPSEPGKPVPPAKEEPKKPSKPVEQGKVVTPVIEINEKVKTVTPVKAQQPKQVDQKELPQTGSEESTNKGMLFGGLFGILGLALLRRNKKNNKA

SEQ ID NO: 40382 - protein, 233 aa, Staphylococcus aureus
  subsp. aureus MSHR1132
MKKTIMASSLAVALGVTGYAASTGHEAHAAEVNVDQAHLVDLAHNHQDQLNAAPIKDGAYDIHFVKDGFQYNFTSNGTTWSWSYEAANGQTAGFSNVAGADYTTSYNQGSDVQSVSYNAQSSNSNVAAVSAPTYHNYSTSTTSSSVRLSNGNTAGATGSSAAQIMAQRTGVSASTWAAIIARESNGQVNAYNPSGASGLFQTMPGWGPTGTVDQQINAAVKAYNAQGLSAWGF

SEQ ID NO: 40383 - protein, 950 aa, Staphylococcus aureus
  subsp. aureus MSHR1132
MKKRIDYLSNKQNKYSIRRFTVGTTSVIVGATILFGIGNHQAHASEKSNDTTQSSTNNASADSEKNKMIETPQSNTTANDTADISTNTDSALVDSTTQSTSTQTSNTTTTEQSSTNNTTPSSDNQTSSVKSESPQTTAIQDQATAAKPQDQTVPQEVNSKVDKSTSDANSASTNSELKSPQILDLPQSSPQTSASNNQSISNTQAVNKPSVRTRALRSLAAAEPVVNAADNKGTNVNDKVTASDFKLEKTTFDPNQSGNTFMAANFKVTGQVKSGDYFTAKLPDSLTGNGDVDYSNSNNTMPIADIKSTNGDVVAKATYDILTKTYTFVFTDYVNGKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVKDTSKLSDSYYADPNDSNLTEVTDQFNSRVYYEHPNVASIKFGDITKTYVILVEGHYDNTGKNLKTQVIQENVDPVTGRDYSIFGWNNENVVRYGGGSADGDSAVNPVDPTPGPPVDPEPSPDPEPEPTPDPEPSPDPEPEPTPDPEPSPDPEPSPDPEPEPTPDPEPSPDPEPEPTPDPEPSPDPGSDSDSDTDSDSDSDSGSDSDSDSESDSDSDSDSDSDSDLDSDSDSDSDSDSDSDSDSDSDSDSDSDSDSDSDNDSDSDSDSDSDSDSDSDSDSDSDSDFDSDSDSDSDSDSDSDNDSDPDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSEVAPPNNEQKAPTNPKGESKLSNQVSKQDISDALPETGDKSENTNVTLFGAMMTLLGSLLLFRRRKKDNNDNA

SEQ ID NO: 40384 - protein, 2280 aa, Staphylococcus aureus
  subsp. aureus MSHR1132
MSKRQKAFHDSLVNEKTRVKLYKSGKNWVKSGIKELEMFKIIGLPFISQNIDKYDNDSVSKKMTSYGLKTTAVIGGAFTVNMLHDQQAFAASDAPLTSELNTQSETVGNQNSTTIEASTSTTNSTNVTKNSSSVQTSNSDTTSSEKSESVTSTVNSTSNQQDKTASTSESTSSKNTTSNYDTKSTASTSSTEQQSNTLINQSTASNNTSQSTTPSSANLNKTSTTSTSTTPVKLRTFSRLAMSTFASATTTSTITANTITVNKDNFKQYMTTSGNATYDQSTGIVTLTQDSTSQKGAITLGTRIDSNKSFHFSGKVNLGNKYEGYGNGGDGIGFAFSPGLLGETGLNGAAVGIGGLSNAFGFKLDTYHNTSKPNTAAKANADPSSVAGGGAFGAFVTTDSYGVATTYTSSSTADNAAKLKVQPTNNTFQNFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALSAKGYNYTSVDSSYASTYNDTNKTVKMTNAGQSVTYYFTDVKAPTVTVGNQTTEVGKSMNPIVLTTTDNGTGTVTNTVTGLPSGLSYDSATNSIVGTPTKVGQSTVSVVSTDQANNKSTTNFTINVVDTTAPTVTPIGDQSSEVFSPISPIKIATQDNSGNTVTNTVTGLPSGLTFDSTTNTISGTPTNIGTSTITIVSTDTSGNKTTTTFKYEVTRNSMSDSVSTSSSTLQSQSVSSSTVNSQSASTSTSESIATSTSASTSKSTSVSLSDSASVSKSLSTSESNSASSSTSASLANSQSVSSSMSDSASKSTSLSDSISNSSSTEKSESLSTSTSDSLRTSMSLSDSLSMSTSGSLSKSQSLSTSTSGSTSTSQSLSESTSNAISTSTSLSESVSTSESISISNSIADSQSASTSKSESQSTSISLSTSDSKSMSTSESLSDSTSTSGSVSGSLSLSGSQSMSTSTSESLSTSKVSSESVSTSDSLAASTSKSTSVSESLSTSQSSSASESLSDSISTSDSTSKSQSLSTSQSDSSSKSMSLSNSLRMSESLSTSTSTSTSMSGSTSLSTSLSDSKSASMSASTASSESVSQSIMTSTSNSASTSTSESTSVSEHTSASLSTSKSLSTSESDSISDSASVSGSASKLTSESLSTSISASESNSTSDSKSQSLSAFLSESVSESTSESTSESLSGSTSTSMSLSDSTSESGSTSTSLSTSTSGSESISASTSDSISASTAKSASASTSLSQSMSTSMSGSTSVSTSLSDSTSTSKSNSISTSESTSDSISTSKSDSLSTSTSLSESTSTSESGSTSMSESKSDSTSTSTSTSESDSESTSTSTSTSLSDSISTSLSLSASMNQSGIDSNSASQSASTSTSTSTSESDSLSTSTYTSHSTSASESTSTSTSLSDSSSISKSTSQSGSTSTSTSLSDSESVSDSESKSESTSESNSTSTSTSLSDSSSISDSASESKSESASTSTSTSESDSSSTSLSDSTSASMQSSESDSQSTSTSLSNSQSTSTSNRMSTIASESVSESTSESGSTSESTSESDSTSTSLSDSQSTSRSTSASGSASTSTSTSDSRSTSASTSTSMSTSTLDSQSMSLSTSTSTSVSDSTSLSDSVSDSTSDSTSTSTSGSMSVSISLSDSTSTSTSASEVMSASISDSQSMSESVNDSESVSESNSESDSKSTSGSTSVSDSGSLSDSTSLRKSESVSESSSLSGSQSMSDSVSTSDSSSLSVSTSLRSSESVSDSDSLSDSTSTSGSTSTSTSGSLSISISLSGSESVSESTSLSDSISMSDSTSTSESDSLSGSISLSDSTSLSTSDSLSDSKSLSSSQSMSGSESTSTSVSDSQSSSTSNSEFDSMSISASESDSISTSDSTSISGSNSTSTSLSTSDSMSGSVSVSTSTSLSDSISGSISVSDSSSLSTSESLSNSMSQSQSTSTSGSSSLSSSISSSMSTSASTSTSQSTSVSTSLSTSDSISESTSISISGSQSIVESESTSDSTSISVSESVSGSTLMSESESNSMSQSQSLSDSTSSSESISDSISISTSESLSMSSSILNSASISNSNSMSMSGSNSTSTSVSMSMSDSDSTSTSESLSVSVSTSMSESTSISESSSISDSISTSTSESDSMHPSDSTSTSHTQIASASSSTSESMAPNTNVSQSATHSQSTLSETSEAMKQDATSTHSNKKLPETGDSIKQGGLLGGVMTLLIGLGLMKRKKKNDEDKEDDTQA

SEQ ID NO: 40385 - protein, 680 aa, Staphylococcus aureus
  subsp. aureus MSHR1132
MRQSQNKYSIRKFSVGASSILIATLLFLSGGHAQAAEKQVNMGNSQEDTVTAQSIGDQQTRENANYQRENGVDEQQHTENLTKNLHNDKTTSEKTNQKADEINKDQLKDDKKSSLNNKNIQRDTTKNHNANLSNVNQGLEQNVNDGKQSKVASQQQAKEGDNSQDSNANNNLPSSSLTKQGPSLDKTEQASQPEIVNETEIEKVQPQQKNQTNDENTNHNFNDEQAVNSKKDVKSLQVSDLKDNQKSPVEPTNDNDNKKELNILKNSAVATLPNKGTKELTAKAKGDQTNKVAKQGQYKNQDPIVLVHGFNGFTDDINPSVLAHYWGGNKMNIRQDLEENGYKAYEASISAFGSNYDRAVELYYIKGGRVDYGAAHAAKYGHERYGKTYEGVYKDWKPGQKIHLVGHSMGGQTIRQLEELLRNGSREEIEYQKQHGGEISPLFKGNHDNMISSITTLGTPHNGTHASDLAGNEALVRQVVFDIGKMFGNKNSRVDFGLAQWGLKQKPNESYIDYVKRVKQSNLWKSKDNGFYDLTREGATELNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 40386 - protein, 232 aa, Staphylococcus aureus; identical to SEQ ID NO: 30584
  subsp. aureus ST228

SEQ ID NO: 40387 - protein, 1038 aa, Staphylococcus aureus; identical to SEQ ID NO: 30590
  subsp. aureus ST228

SEQ ID NO: 40388 - protein, 1044 aa, Staphylococcus aureus
  subsp. aureus ST228
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKTTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVIY

SEQ ID NO: 40389 - protein, 242 aa, Staphylococcus aureus; identical to SEQ ID NO: 30399
  subsp. aureus ST228

SEQ ID NO: 40390 - protein, 239 aa, Staphylococcus aureus; identical to SEQ ID NO: 30622
  subsp. aureus ST228

SEQ ID NO: 40391 - protein, 239 aa, Staphylococcus aureus; identical to SEQ ID NO: 32649
  subsp. aureus ST228

SEQ ID NO: 40392 - protein, 1141 aa, Staphylococcus aureus
  subsp. aureus ST228
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDADSDSDSDSDSDADSDSDADSDSDADSDSDADSDSDADSDSDSDSDSDADSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 40393 - protein, 350 aa, Staphylococcus aureus; identical to SEQ ID NO: 30602
  subsp. aureus ST228

SEQ ID NO: 40394 - protein, 241 aa, Staphylococcus aureus; identical to SEQ ID NO: 30571
  subsp. aureus ST228

SEQ ID NO: 40395 - protein, 691 aa, Staphylococcus aureus; identical to SEQ ID NO: 30511
  subsp. aureus ST228

SEQ ID NO: 40396 - protein, 226 aa, Staphylococcus aureus; identical to SEQ ID NO: 30577
  subsp. aureus ST228

SEQ ID NO: 40397 - protein, 1385 aa, Staphylococcus aureus
  subsp. aureus ST228
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKTTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 40398 - protein, 681 aa, Staphylococcus aureus; identical to SEQ ID NO: 30598
  subsp. aureus ST228

SEQ ID NO: 40399 - protein, 241 aa, Staphylococcus aureus; identical to SEQ ID NO: 30608
  subsp. aureus ST228

SEQ ID NO: 40400 - protein, 2186 aa, Staphylococcus aureus; identical to SEQ ID NO: 38311
  subsp. aureus ST228

SEQ ID NO: 40401 - protein, 311 aa, Staphylococcus aureus; identical to SEQ ID NO: 30617
  subsp. aureus ST228

SEQ ID NO: 40402 - protein, 160 aa, Staphylococcus aureus
  subsp. aureus ST228
MNIIDGNSVNNLALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 40403 - protein, 51 aa, Staphylococcus aureus; identical to SEQ ID NO: 32234
  subsp. aureus ST228

SEQ ID NO: 40404 - protein, 942 aa, Staphylococcus aureus
  subsp. aureus ST228
MFLSLKTLYRKRTVIWPFYFYTIIRTLSTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 40405 - protein, 231 aa, Staphylococcus aureus; identical to SEQ ID NO: 30582
  subsp. aureus ST228

SEQ ID NO: 40406 - protein, 953 aa, Staphylococcus aureus
  subsp. aureus ST228
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDGNGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 40407 - protein, 1023 aa, Staphylococcus aureus
  subsp. aureus ST228
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDADSDSDSDSDSDADSDSDADSDSDADSDSDADSDSDADSDSDSDSDSDADSDSDSDSDSDSDSD

SEQ ID NO: 40408 - protein, 251 aa, Staphylococcus aureus; identical to SEQ ID NO: 30946
  subsp. aureus ST228

SEQ ID NO: 40409 - protein, 203 aa, Staphylococcus aureus; identical to SEQ ID NO: 30576
  subsp. aureus ST228

SEQ ID NO: 40410 - protein, 254 aa, Staphylococcus aureus; identical to SEQ ID NO: 30809
  subsp. aureus ST228

SEQ ID NO: 40411 - protein, 51 aa, Staphylococcus aureus; identical to SEQ ID NO: 32222
  subsp. aureus ST228

SEQ ID NO: 40412 - protein, 811 aa, Staphylococcus aureus; identical to SEQ ID NO: 32625
  subsp. aureus ST228

SEQ ID NO: 40413 - protein, 231 aa, Staphylococcus aureus; identical to SEQ ID NO: 30630
  subsp. aureus ST228

SEQ ID NO: 40414 - protein, 258 aa, Staphylococcus aureus; identical to SEQ ID NO: 30410
  subsp. aureus ST228

SEQ ID NO: 40415 - protein, 890 aa, Staphylococcus aureus
  subsp. aureus ST228
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDGNGKYRFDNLDSGKYKVIFEKPAGLTQTGTNTTEDDKDADGGEVDVTITDHDDFTLDNGYYEEETSDSDSDSDSDQTQIATQTQIATQTATQTQIVIQIRTATQIQTANQIRIATQTQIATQTATQIQTVTQTQTATQIQTAIQIRIATQIQIAIRTQTTTQILTAIQTQIATQIQTATQIQTAIQIQIAIQIQTATQIQIATQTQTAIQTQIATQTAIQIRIAIQIQMQVNILRLNQ

SEQ ID NO: 40416 - protein, 234 aa, Staphylococcus aureus; identical to SEQ ID NO: 32190
  subsp. aureus ST228

SEQ ID NO: 40417 - protein, 165 aa, Staphylococcus aureus; identical to SEQ ID NO: 30418
  subsp. aureus ST228

SEQ ID NO: 40418 - protein, 257 aa, Staphylococcus aureus; identical to SEQ ID NO: 30259
  subsp. aureus ST228

SEQ ID NO: 40419 - protein, 325 aa, Staphylococcus aureus; identical to SEQ ID NO: 30407
  subsp. aureus ST228

SEQ ID NO: 40420 - protein, 322 aa, Staphylococcus aureus; identical to SEQ ID NO: 38359
  subsp. aureus ST228

SEQ ID NO: 40421 - protein, 434 aa, Staphylococcus aureus
  subsp. aureus ST228
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGTNAILGVSIAVARAAADLLGQPLYKYLGGFNGKQLPVPMMNIVNGGSHSDAPIAFQEFMILPVGATTFKESLRWGTEIFHNLKSILSKRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 40422 - protein, 297 aa, Staphylococcus aureus; identical to SEQ ID NO: 32648
  subsp. aureus ST228

SEQ ID NO: 40423 - protein, 327 aa, Staphylococcus aureus; identical to SEQ ID NO: 30616
  subsp. aureus ST228

SEQ ID NO: 40424 - protein, 196 aa, Staphylococcus aureus; identical to SEQ ID NO: 30587
  subsp. aureus ST228

SEQ ID NO: 40425 - protein, 856 aa, Staphylococcus aureus
  subsp. aureus ST228
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVIY

SEQ ID NO: 40426 - protein, 877 aa, Staphylococcus aureus
  subsp. aureus ST228
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 40427 - protein, 815 aa, Staphylococcus aureus
  subsp. aureus ST228
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNRH

SEQ ID NO: 40428 - protein, 383 aa, Staphylococcus aureus; identical to SEQ ID NO: 31488
  subsp. aureus ST228

SEQ ID NO: 40429 - protein, 2481 aa, Staphylococcus aureus; identical to SEQ ID NO: 31413
  subsp. aureus ST228

SEQ ID NO: 40430 - protein, 2271 aa, Staphylococcus aureus; identical to SEQ ID NO: 30597
  subsp. aureus ST228

SEQ ID NO: 40431 - protein, 331 aa, Staphylococcus aureus; identical to SEQ ID NO: 30615
  subsp. aureus ST228

SEQ ID NO: 40432 - protein, 227 aa, Staphylococcus aureus; identical to SEQ ID NO: 30585
  subsp. aureus ST228

SEQ ID NO: 40433 - protein, 233 aa, Staphylococcus aureus; identical to SEQ ID NO: 30591
  subsp. aureus ST228

SEQ ID NO: 40434 - protein, 291 aa, Staphylococcus aureus; identical to SEQ ID NO: 30390
  subsp. aureus ST228

SEQ ID NO: 40435 - protein, 227 aa, Staphylococcus aureus; identical to SEQ ID NO: 30586
  subsp. aureus ST228

SEQ ID NO: 40436 - protein, 271 aa, Staphylococcus aureus; identical to SEQ ID NO: 38342
  subsp. aureus ST228

SEQ ID NO: 40437 - protein, 645 aa, Staphylococcus aureus; identical to SEQ ID NO: 30601
  subsp. aureus ST228

SEQ ID NO: 40438 - protein, 214 aa, Staphylococcus aureus; identical to SEQ ID NO: 30966
  subsp. aureus ST228

SEQ ID NO: 40439 - protein, 891 aa, Staphylococcus aureus; identical to SEQ ID NO: 30788
  subsp. aureus ST228

SEQ ID NO: 40440 - protein, 470 aa, Staphylococcus aureus
  subsp. aureus ST228
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLTEEQRNGFIQSLKDDPSVSKEILAEAKKLNDAQAPKEEDNKKPGKEDGNKPGKEDNNKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40441 - protein, 241 aa, Staphylococcus aureus; identical to SEQ ID NO: 30607
  subsp. aureus ST228

SEQ ID NO: 40442 - protein, 321 aa, Staphylococcus aureus; identical to SEQ ID NO: 30959
  subsp. aureus ST228

SEQ ID NO: 40443 - protein, 446 aa, Staphylococcus aureus
  subsp. aureus ST228
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKLKRFHSRKNVNLIRI

SEQ ID NO: 40444 - protein, 193 aa, Staphylococcus aureus
  subsp. aureus ST228
MTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 40445 - protein, 315 aa, Staphylococcus aureus; identical to SEQ ID NO: 38319
  subsp. aureus ST228

SEQ ID NO: 40446 - protein, 485 aa, Staphylococcus aureus
  subsp. aureus str. Newbould 305
TPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPDKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 40447 - protein, 321 aa, Staphylococcus aureus; identical to SEQ ID NO: 30959
  subsp. aureus str. Newbould 305

SEQ ID NO: 40448 - protein, 644 aa, Staphylococcus aureus; identical to SEQ ID NO: 34015
  subsp. aureus str. Newbould 305

SEQ ID NO: 40449 - protein, 350 aa, Staphylococcus aureus; identical to SEQ ID NO: 34016
  subsp. aureus str. Newbould 305

SEQ ID NO: 40450 - protein, 241 aa, Staphylococcus aureus; identical to SEQ ID NO: 30738
  subsp. aureus str. Newbould 305

SEQ ID NO: 40451 - protein, 817 aa, Staphylococcus aureus
  subsp. aureus str. Newbould 305
MSMTYRMKKWQKLSTITLLMAGAITLNGGEFRSIDKNQIAVADTNVQTPDYEKLRNTWLNVNYGYDQYDEKNDAMKKKFDATEKEAEKLLSSMKTESGRTYLWDSAKDLDNKSADMTRTYRNIEKIAEAMKHKDTKLNTPDNKNKVKDALEWLHKNAYGKEPVKKLEELKTNFSKSAPQKNTNLNWWDYEIGTPRALTNTLILLKEDFTDEEKKKYTAPIKTFAPKSDEILSSVGKAEPAKGGNLVDISKVKLLESIIEEDATMMKESIEAFNKVFTYVQSNATGKERNGFYKDGSYIDHQDVPYTGAYGVVLLEGISQMMPMIKETPFKDSNQNDTTLKSWIDEGFMPLIYKGEMMDLSRGRAISRENETSHSTSATVMKSLLRLSDAMDESTKAKYKQIVKTSVKSDSSYKQNDYLSSYSDISKMKSLIEDSTISTNGLTQQLKIYNDMNRVTYHNKDLDFAFGLSMTSKNVAHYESINGENLKGWHTGAGMSYLYNSDVKHYRDNFWATADMKRLAGTTTLDNEEPKENKNSDKTFVGGTKFDDQHASIGMDFENQDKTLTAKKSYFILNDKIVFLGTGIKSTDSSKNPVTTIENRKSNGYTLFTDDKQTTASNINDQETNSVFLESTDTKKNIGYHFLNESKITVKKESHTGKWSDINKSQKSDDKTDEYYEVTQKHSNTDDKYAYVLYPGLSKDNFKSKASQVTIVKQDDDFHIVKDNESVWAGVNYSNSTQTFDINNTKVEVKAKGMFILKNKDDNTYECSFYNPESTNTASDIESKISMTGYSITNKNTSTSNESGVRFELQQTLNKDDN

SEQ ID NO: 40452 - protein, 925 aa, Staphylococcus aureus
  subsp. aureus str. Newbould 305
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDLDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPAKPMSTVKDQHKTAKALPETGSENNNSNNGTLFGGLFAALGSLLLFGRRKKQNK

SEQ ID NO: 40453 - protein, 945 aa, Staphylococcus aureus
  subsp. aureus str. Newbould 305
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSASDSDSDSDSDSSSDSDSESDSNSDSESGSNNNVVPPNSPKNGTNDSNKNEAKDSKEPLPDTGSEDEANSSLIWGLLASLGSLLLFRRKKENKDKK

SEQ ID NO: 40454 - protein, 446 aa, Staphylococcus aureus; identical to SEQ ID NO: 40329
  subsp. aureus str. Newbould 305

SEQ ID NO: 40455 - protein, 212 aa, Staphylococcus aureus
  subsp. aureus str. Newbould 305
MMKKVISLFVAILSVLIFTDNANAENNKPEGVNENSNLIPVRQPDANYPGPVSDIARVKKLDNLIDGTKDPDVIKQLKDDNEVPNNAVKAKDSKIVSDCRHLLKHPDNLMDGTKDPNVINQLKNANGTSNNSAVNPSIKANDIHTKSNKQMAKQQSIHLDSKSKSVHKQQLKELPKTGVNNESNTAIMVLFIGLILLVVSLVTRFIKLNSHQ

SEQ ID NO: 40456 - protein, 231 aa, Staphylococcus aureus; identical to SEQ ID NO: 30578
  subsp. aureus str. Newbould 305

SEQ ID NO: 40457 - protein, 234 aa, Staphylococcus aureus
  subsp. aureus str. Newbould 305
MNMKFTAIAKAIFVLGILTTSAMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGAADKGRIVINMKDENKYEIDLSDKLDFERMADVISSEQIKNIEVNLK

SEQ ID NO: 40458 - protein, 233 aa, Staphylococcus aureus; identical to SEQ ID NO: 34038
  subsp. aureus str. Newbould 305

SEQ ID NO: 40459 - protein, 62 aa, Staphylococcus aureus; identical to SEQ ID NO: 30610
  subsp. aureus str. Newbould 305

SEQ ID NO: 40460 - protein, 325 aa, Staphylococcus aureus; identical to SEQ ID NO: 30407
  subsp. aureus str. Newbould 305

SEQ ID NO: 40461 - protein, 787 aa, Staphylococcus aureus
  subsp. aureus str. Newbould 305
MKFKSLITTTLALGVIASTGANFNTNEASAAAKPLDKSSSTLHHGHSNIQIPYTITVNGTSQNILSSLTFNKNQNISYKDIENKVKSVLYFNRGISDIDLRLSKQAEYTVHFKNGTKRVIDLKSGIYTADLINTSDIKAISVNVDTKKQPKDKAKANVQVPYTITVNGTSQNILSNLTFNKNQNISYKDLEDKVKSVLESNRGITDVDLRLSKQAKYTVNFKNGTKKVIDLKAGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHVKDVKRIEITVKTGTKAKADRYVPYTIAVNGTSTPILSDLKFTGDPRVGYKDITKKVKSVLKHDRGIGERELKYAKKATYTVHFKNGKKKVINLNSKISQLNLLYVQDIKKIDIDVKTGSKAKADSYVPYTIAVNGTSTPILSKLKISNKQLISYKYLNDKVKSVLKNERGISDLDLKFAKQAKYTVYFKNGKKQVVNLKSDIFTPNLFSAKDIKKIDIDVKTGSKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKINKSNNVKFPVTINKFENIVSNEFVFYNASKITINDLSIKLKSAIANDQGITKHDIELAERAVYKVYFKNGSSKYVDLKTEYKDERVFKATDIKKVDIELKF

SEQ ID NO: 40462 - protein, 109 aa, Staphylococcus aureus; identical to SEQ ID NO: 33345
  subsp. aureus str. Newbould 305

SEQ ID NO: 40463 - protein, 322 aa, Staphylococcus aureus; identical to SEQ ID NO: 33409
  subsp. aureus str. Newbould 305

SEQ ID NO: 40464 - protein, 238 aa, Staphylococcus aureus; identical to SEQ ID NO: 30740
  subsp. aureus str. Newbould 305

SEQ ID NO: 40465 - protein, 268 aa, Staphylococcus aureus
  subsp. aureus str. Newbould 305
MKEIKDNLNLHYDIQIQNIITKKHKLTIITGGFFTMKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 40466 - protein, 985 aa, Staphylococcus aureus; identical to SEQ ID NO: 34053
  subsp. aureus str. Newbould 305

SEQ ID NO: 40467 - protein, 241 aa, Staphylococcus aureus; identical to SEQ ID NO: 33853
  subsp. aureus str. Newbould 305

SEQ ID NO: 40468 - protein, 239 aa, Staphylococcus aureus
  subsp. aureus str. Newbould 305
MEHTTMKMTAIAKASLALGILATGTITSTHQTVNASEHEAKYENVTKDIFDLRDYYSGASKELKNVTGYRYSKCGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 40469 - protein, 306 aa, Staphylococcus aureus; identical to SEQ ID NO: 30803
  subsp. aureus str. Newbould 305

SEQ ID NO: 40470 - protein, 2473 aa, Staphylococcus aureus; identical to SEQ ID NO: 34049
  subsp. aureus str. Newbould 305

SEQ ID NO: 40471 - protein, 231 aa, Staphylococcus aureus; identical to SEQ ID NO: 33623
  subsp. aureus str. Newbould 305

SEQ ID NO: 40472 - protein, 29 aa, Staphylococcus aureus
  subsp. aureus str. Newbould 305
MISMAQDIISTIGDLVKWIIDTVNKFTKK

SEQ ID NO: 40473 - protein, 331 aa, Staphylococcus aureus
  subsp. aureus str. Newbould 305
MMVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPRDVYAFPYYYVYNDFSDHYPIKAYSK

SEQ ID NO: 40474 - protein, 165 aa, Staphylococcus aureus; identical to SEQ ID NO: 30418
  subsp. aureus str. Newbould 305

SEQ ID NO: 40475 - protein, 1151 aa, Staphylococcus aureus
  subsp. aureus str. Newbould 305
MISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTNHSTKPVATAPTSVAPKRLNAKMRFAVAQPAAVASNNVNDLITVTKQTIKVGDGKDKVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFILDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 40476 - protein, 1998 aa, Staphylococcus aureus
  subsp. aureus str. Newbould 305
MSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSTSTSASLSGSESESDSQSISTSASESTSESTSTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSESLSDSMAQSQSTSTSASGSLSTSISTSMSMSASTSTSQSTSVSTSLSTSDSISDSTSISISGSQSTVESESTSDSTSISDSESLSTSDSDSTSTSTSDSTSSSTSTSISESLSTSGSGSTSVSDSTSMSESDSTSVSMSQSMSGSTHNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 40477 - protein, 365 aa, Staphylococcus aureus
  subsp. aureus str. Newbould 305
MEHTTMKITTIAKTSLALGLLTTGVITTTTQAANATTPSSTKVEAPQQTANATTPPSTKVETPQQTPNATTPSSTKVETTQAANATTPSSTKVETPQQTPNPPTSPSTKVETPQQAANATTPSSTKVEVPQSTPLSTKVEAPQSKPNATTPPSSNVDTSPPQSPTTKQVPTEINPKFKDLRAYYTKPSIEFKNEIGIILKKWTTIRFMNVVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 40478 - protein, 227 aa, Staphylococcus aureus; identical to SEQ ID NO: 33376
  subsp. aureus str. Newbould 305

SEQ ID NO: 40479 - protein, 845 aa, Staphylococcus aureus
  subsp. aureus str. Newbould 305
MVTDSFHASTNFPILWKVKLLINHNINCARATQKGDMSMTYKMKKWQKLSTITLLMAGVITLNGGEFRSIDKHQIAVADTNVQTPDYEKLRNTWLDVNYGYDKYDENNPDMKKKFDATEKEAEKLLKEMKTESDRKYLWENSKDLDTKSADMTRTYRNIEKIAEAMKHKDTKLKTDENKKKVKDALDWLHENAYGKEPDKKVKELTENFKITDSSKKKALNWWDYEIGTPRALTNTLILLNGDISSDEKKKYTAPIKTFAPDSDKILSSVGKPEQAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLKSWIDDGFLPLIYKGEMMDLSRGRAISRENETSHSASATVMISLLRLSDAMDESTKAKYKQIVKTSVKSDSSYKQNDYLSSYSDISKMKSLIEDSTISTNGLTQQLKIYNDMDRVTYHNKELDFAFGLSMTSKNVARYESINGENLKGWHTGAGMSYLYNSDVKHYRDNFWATADMTRLPGTTTLNDMPSTNTKNDNSFVGGTKFDEQHASIGMDFENQDKTLTAKKSYFILNDKIVFLGTGIKSTGSSENPITTIENRKANEYKLYKDDIENTTSNDNTQETHSVFLESSDTKKNIGYHFLDKPKISVKKETHIGKWKDINNSQSNTQKNDDYYEVTQTHNTSDSKYAYVLYPGLTKSDFKSKNNIVNIIKQDEDFHVIKDNDGIFAGVNYSDSTKTFDINGTKVEVKAKGMFVIKKKDDKTYECSFYNPETTNTASNIESKISIAGYTLINKSVTNSNEAGVNFELTK

SEQ ID NO: 40480 - protein, 895 aa, Staphylococcus aureus; identical to SEQ ID NO: 34054
  subsp. aureus str. Newbould 305

SEQ ID NO: 40481 - protein, 315 aa, Staphylococcus aureus; identical to SEQ ID NO: 30440
  subsp. aureus str. Newbould 305

SEQ ID NO: 40482 - protein, 350 aa, Staphylococcus aureus; identical to SEQ ID NO: 33885
  subsp. aureus str. Newbould 305

SEQ ID NO: 40483 - protein, 338 aa, Staphylococcus aureus
  subsp. aureus str. Newbould 305
MIKQLYKNITICTLALSTTFTLLPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKNKMPVTVSEGFNPEFLAVMSHDKKDEGKSKFVVHYKRSMDEFKIDWNRHGFWGYWSGENHVDKKEEKLSALYEVDWKTHNVKFVKVLNDNEKK

SEQ ID NO: 40484 - protein, 241 aa, Staphylococcus aureus; identical to SEQ ID NO: 30739
  subsp. aureus str. Newbould 305

SEQ ID NO: 40485 - protein, 1336 aa, Staphylococcus aureus
  subsp. aureus str. Newbould 305
MGTASILVGTTLIFGLGNQEAKAAESTNKELNEATTSASDNQSSGKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVVFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 40486 - protein, 434 aa, Staphylococcus aureus [sequence omitted]

SEQ ID NO: 40487 - protein, 1016 aa, Staphylococcus aureus
  subsp. aureus str. Newbould 305
MGAASVFLGTMIVVGMGQDKEAAASEQKTTTVEENGNSATDNKVNETQTTTTNVNTIDETQSYSATATEQPSNATQVTTEKAPKAVQAPQTAQPANVETVKEEVVKEEANPQVKETTQSQDNSGDQRQVDLTPKKATQNQAAETQVEVAQPRTVSESKPRVTRSADVAEAKEASDAKVETGTDVTSKVTVESGSIEAPQGNKVEPHAGQRVVLKYKLKFEKGLHKGDYFDFTLSNNVNTYGVSTARKVPEIKNGSVVMATGQLLGNGKIRYTFTDYIDYKVNVTADLEINLFIDPKTVQSNGQQTITSTLNDKETKNTLPIEYNPGVSNSYANVNGSIETFDKGNNKFTHVAYIKPQNGHKSDSVSITGTLTQGSKANGNVPTVKVYEVLKDAKELPESVYANISDSTMFKDVTQEMKDKLKVENNGSYKLDIEKLEKSYVIHYDGEYLSGSDQVNFRTHMFGYPEQQYKYYYTHLGYQLTWDNGLVLYSNKAKGDGTNGTITESNNMTFDEEYGTGVITGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEQGGNIIDIDFDSVPQIHGFNKHNEIIEEDTNKDKPNYQFGGHNIVDFEEDTLPKVSGQNEGQQTIEEDTTPPTPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 40488 - protein, 931 aa, Staphylococcus aureus; identical to SEQ ID NO: 34040
  subsp. aureus str. Newbould 305

SEQ ID NO: 40489 - protein, 520 aa, Staphylococcus aureus
  subsp. aureus str. Newbould 305
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNNKPGKEDGNKPGKEDNKKPGKEDNKKPGKEDNKKPGKEDGNKPGKEDNKKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40490 - protein, 203 aa, Staphylococcus aureus; identical to SEQ ID NO: 30347
  subsp. aureus str. Newbould 305

SEQ ID NO: 40491 - protein, 356 aa, Staphylococcus aureus
  subsp. aureus str. Newbould 305
MKMRTIAKTSLALGLLTTGAITVTTQSVKAEKVQSTKVDKISTLKAERLAMINITAGANTVTTQAAKTGQERTPKLEKAPNTNEEKTSTSKIEKVSQPKQEAQKLLNISATPAPKQEQSQTTTESTTPKTRVTTPPSTNTPQPMQSTKSDTPQSPNIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELSITKKDNQGMISRDVSEYMITKEEISLKELDFKLRKQLIEKHNLYGNMGSGTIVIKMKNGGKYTFELHKKLQEHRMADVIEVTNIDKIEVNIK

SEQ ID NO: 40492 - protein, 232 aa, Staphylococcus aureus; identical to SEQ ID NO: 34059
  subsp. aureus str. Newbould 305

SEQ ID NO: 40493 - protein, 226 aa, Staphylococcus aureus; identical to SEQ ID NO: 34057
  subsp. aureus str. Newbould 305

SEQ ID NO: 40494 - protein, 231 aa, Staphylococcus aureus; identical to SEQ ID NO: 34063
  subsp. aureus str. Newbould 305

SEQ ID NO: 40495 - protein, 327 aa, Staphylococcus aureus; identical to SEQ ID NO: 34061
  subsp. aureus str. Newbould 305

SEQ ID NO: 40496 - protein, 331 aa, Staphylococcus aureus; identical to SEQ ID NO: 34042
  subsp. aureus str. Newbould 305

SEQ ID NO: 40497 - protein, 2186 aa, Staphylococcus aureus; identical to SEQ ID NO: 34064
  subsp. aureus str. Newbould 305

SEQ ID NO: 40498 - protein, 291 aa, Staphylococcus aureus
  subsp. aureus str. Newbould 305
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKNYFSA

SEQ ID NO: 40499 - protein, 138 aa, Staphylococcus aureus; identical to SEQ ID NO: 34023
  subsp. aureus str. Newbould 305

SEQ ID NO: 40500 - protein, 434 aa, Staphylococcus aureus [sequence omitted]

SEQ ID NO: 40501 - protein, 885 aa, Staphylococcus aureus; identical to SEQ ID NO: 33224
  subsp. aureus T0131

SEQ ID NO: 40502 - protein, 44 aa, Staphylococcus aureus; identical to SEQ ID NO: 30513
  subsp. aureus T0131

SEQ ID NO: 40503 - protein, 242 aa, Staphylococcus aureus; identical to SEQ ID NO: 30396
  subsp. aureus T0131

SEQ ID NO: 40504 - protein, 242 aa, Staphylococcus aureus; identical to SEQ ID NO: 33198
  subsp. aureus T0131

SEQ ID NO: 40505 - protein, 231 aa, Staphylococcus aureus; identical to SEQ ID NO: 31073
  subsp. aureus T0131

SEQ ID NO: 40506 - protein, 2478 aa, Staphylococcus aureus; identical to SEQ ID NO: 33222
  subsp. aureus T0131

SEQ ID NO: 40507 - protein, 807 aa, Staphylococcus aureus; identical to SEQ ID NO: 30716
  subsp. aureus T0131

SEQ ID NO: 40508 - protein, 141 aa, Staphylococcus aureus
  subsp. aureus T0131
MKLKSFVTATLALGLLSTVGAALPSHEASADSNNGYKEMTVDGYHTVPYTISVDGITALHRTYFIFPENKNVLYQEIDSKVKNELASQRGVTTEKINNAQTATYTLTLNDGNKKVVNLKKNYDAKNSIDPSTIKQIQIVVK

SEQ ID NO: 40509 - protein, 645 aa, Staphylococcus aureus
  subsp. aureus T0131
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKDLDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 40510 - protein, 350 aa, Staphylococcus aureus; identical to SEQ ID NO: 30602
  subsp. aureus T0131

SEQ ID NO: 40511 - protein, 109 aa, Staphylococcus aureus; identical to SEQ ID NO: 30744
  subsp. aureus T0131

SEQ ID NO: 40512 - protein, 165 aa, Staphylococcus aureus; identical to SEQ ID NO: 30742
  subsp. aureus T0131

SEQ ID NO: 40513 - protein, 319 aa, Staphylococcus aureus; identical to SEQ ID NO: 31078
  subsp. aureus T0131

SEQ ID NO: 40514 - protein, 238 aa, Staphylococcus aureus; identical to SEQ ID NO: 30740
  subsp. aureus T0131

SEQ ID NO: 40515 - protein, 241 aa, Staphylococcus aureus; identical to SEQ ID NO: 30739
  subsp. aureus T0131

SEQ ID NO: 40516 - protein, 241 aa, Staphylococcus aureus; identical to SEQ ID NO: 30738
  subsp. aureus T0131

SEQ ID NO: 40517 - protein, 372 aa, Staphylococcus aureus; identical to SEQ ID NO: 31084
  subsp. aureus T0131

SEQ ID NO: 40518 - protein, 321 aa, Staphylococcus aureus; identical to SEQ ID NO: 30959
  subsp. aureus T0131

SEQ ID NO: 40519 - protein, 315 aa, Staphylococcus aureus; identical to SEQ ID NO: 30440
  subsp. aureus T0131

SEQ ID NO: 40520 - protein, 325 aa, Staphylococcus aureus; identical to SEQ ID NO: 30407
  subsp. aureus T0131

SEQ ID NO: 40521 - protein, 125 aa, Staphylococcus aureus; identical to SEQ ID NO: 33215
  subsp. aureus T0131

SEQ ID NO: 40522 - protein, 967 aa, Staphylococcus aureus; identical to SEQ ID NO: 33181
  subsp. aureus T0131

SEQ ID NO: 40523 - protein, 190 aa, Staphylococcus aureus; identical to SEQ ID NO: 30534
  subsp. aureus T0131

SEQ ID NO: 40524 - protein, 418 aa, Staphylococcus aureus
  subsp. aureus T0131
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDRQSAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDGNKPGKEDGNGVHVVKPGDTVNDIAKANGTTADKIAADNKLAAKNMIKPGQELVVDKKQPANHADANKAQALPETGEENPFIGTTVFGGLSLALGAALLAGRRREL

SEQ ID NO: 40525 - protein, 221 aa, Staphylococcus aureus; identical to SEQ ID NO: 31036
  subsp. aureus T0131

SEQ ID NO: 40526 - protein, 233 aa, Staphylococcus aureus; identical to SEQ ID NO: 31039
  subsp. aureus T0131

SEQ ID NO: 40527 - protein, 897 aa, Staphylococcus aureus
  subsp. aureus T0131
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSESDSDSDSDSDSDSDSDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 40528 - protein, 1759 aa, Staphylococcus aureus; identical to SEQ ID NO: 31045
  subsp. aureus T0131

SEQ ID NO: 40529 - protein, 681 aa, Staphylococcus aureus; identical to SEQ ID NO: 31046
  subsp. aureus T0131

SEQ ID NO: 40530 - protein, 809 aa, Staphylococcus aureus; identical to SEQ ID NO: 31961
  subsp. aureus T0131

SEQ ID NO: 40531 - protein, 691 aa, Staphylococcus aureus; identical to SEQ ID NO: 31040
  subsp. aureus T0131

SEQ ID NO: 40532 - protein, 250 aa, Staphylococcus aureus; identical to SEQ ID NO: 31910
  subsp. aureus T0131

SEQ ID NO: 40533 - protein, 270 aa, Staphylococcus aureus; identical to SEQ ID NO: 35140
  subsp. aureus T0131

SEQ ID NO: 40534 - protein, 203 aa, Staphylococcus aureus; identical to SEQ ID NO: 30770
  subsp. aureus T0131

SEQ ID NO: 40535 - protein, 226 aa, Staphylococcus aureus; identical to SEQ ID NO: 30769
  subsp. aureus T0131

SEQ ID NO: 40536 - protein, 231 aa, Staphylococcus aureus; identical to SEQ ID NO: 30768
  subsp. aureus T0131

SEQ ID NO: 40537 - protein, 352 aa, Staphylococcus aureus; identical to SEQ ID NO: 30767
  subsp. aureus T0131

SEQ ID NO: 40538 - protein, 308 aa, Staphylococcus aureus; identical to SEQ ID NO: 31787
  subsp. aureus T0131

SEQ ID NO: 40539 - protein, 234 aa, Staphylococcus aureus; identical to SEQ ID NO: 31052
  subsp. aureus T0131

SEQ ID NO: 40540 - protein, 231 aa, Staphylococcus aureus; identical to SEQ ID NO: 31761
  subsp. aureus T0131

SEQ ID NO: 40541 - protein, 231 aa, Staphylococcus aureus; identical to SEQ ID NO: 30560
  subsp. aureus T0131

SEQ ID NO: 40542 - protein, 232 aa, Staphylococcus aureus; identical to SEQ ID NO: 31054
  subsp. aureus T0131

SEQ ID NO: 40543 - protein, 232 aa, Staphylococcus aureus; identical to SEQ ID NO: 30765
  subsp. aureus T0131

SEQ ID NO: 40544 - protein, 227 aa, Staphylococcus aureus; identical to SEQ ID NO: 30585
  subsp. aureus T0131

SEQ ID NO: 40545 - protein, 225 aa, Staphylococcus aureus; identical to SEQ ID NO: 30763
  subsp. aureus T0131

SEQ ID NO: 40546 - protein, 895 aa, Staphylococcus aureus; identical to SEQ ID NO: 30734
  subsp. aureus T0131

SEQ ID NO: 40547 - protein, 2186 aa, Staphylococcus aureus; identical to SEQ ID NO: 31059
  subsp. aureus T0131

SEQ ID NO: 40548 - protein, 331 aa, Staphylococcus aureus; identical to SEQ ID NO: 30732
  subsp. aureus T0131

SEQ ID NO: 40549 - protein, 929 aa, Staphylococcus aureus; identical to SEQ ID NO: 33226
  subsp. aureus T0131

SEQ ID NO: 40550 - protein, 1381 aa, Staphylococcus aureus; identical to SEQ ID NO: 30760
  subsp. aureus T0131

SEQ ID NO: 40551 - protein, 1131 aa, Staphylococcus aureus
  subsp. aureus T0131
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 40552 - protein, 281 aa, Staphylococcus aureus; identical to SEQ ID NO: 33190
  subsp. aureus T0131

SEQ ID NO: 40553 - protein, 311 aa, Staphylococcus aureus; identical to SEQ ID NO: 30617
  subsp. aureus T0131

SEQ ID NO: 40554 - protein, 257 aa, Staphylococcus aureus; identical to SEQ ID NO: 30259
  subsp. aureus T0131

SEQ ID NO: 40555 - protein, 274 aa, Staphylococcus aureus; identical to SEQ ID NO: 30872
  subsp. aureus T0131

SEQ ID NO: 40556 - protein, 338 aa, Staphylococcus aureus; identical to SEQ ID NO: 30699
  subsp. aureus T0131

SEQ ID NO: 40557 - protein, 351 aa, Staphylococcus aureus; identical to SEQ ID NO: 30720
  subsp. aureus T0131

SEQ ID NO: 40558 - protein, 678 aa, Staphylococcus aureus
  subsp. aureus TCH130
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKPRTLNRMAVNTVAAPQQGTNVNDKVHFSNIDIAIDKGHVNSTTGKTEFWATSSDVLKLKANYKIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDTYSEEVIVDYGNKKAQPLISSTNYINNEDLSRNMTVYVNQPKNTYTKETLVTNLTGYKFNPDAKNFKIYEVTNQNQFVDSFTPDTSKLTDVTDKFKITYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLT

SEQ ID NO: 40559 - protein, 80 aa, Staphylococcus aureus
  subsp. aureus TCH130
NDSDSDSDSDNDSDSDSDSDAGKHTPAKPMSTVKDQHKTAKALPETGSENNNSNNGTLFGGLFAALGSLLLFGRRKKQNK

SEQ ID NO: 40560 - protein, 1014 aa, Staphylococcus aureus
  subsp. aureus TCH130
MLNRENKTAITRKGMVSNRLNKFSIRKYTVGTASILVGTTLIFGLGNQEAKAAESTNKELNEATTSASDNQSSGKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKY

SEQ ID NO: 40561 - protein, 434 aa, Staphylococcus aureus
  subsp. aureus TCH130
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSKRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFNNLDK

SEQ ID NO: 40562 - protein, 60 aa, Staphylococcus aureus
  subsp. aureus TCH130
AGKHTPVKPMSTTKDHHNKAKALPETGSENNGSNNATLFGGLFAALGSLLLFGRRKKQNK

SEQ ID NO: 40563 - protein, 826 aa, Staphylococcus aureus
  subsp. aureus TCH130
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKEESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTDRSTKPVATAPTSVAPKRVNAKMRFAVAQPAAVASNNVNDLITVTKQTIKVGDGKDNVAAAHDGKDIEYDTELTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKY

SEQ ID NO: 40564 - protein, 60 aa, Staphylococcus aureus
  subsp. aureus TCH130
AGKHTPVKPMSTTKDHHNKAKALPETGNENSGSNNATLFGGLFAALGSLLLFGRRKKQNK

SEQ ID NO: 40565 - protein, 2099 aa, Staphylococcus aureus
  subsp. aureus TCH130
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQAIADKVQAQETAIDANNGSTTEEKTAAKQQAQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKENAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQTSVGPVANNKAKDMQTNDMKASLATVSNGSNSANQDMLNVTNTDDHQAKTKSAQQGKVNKPKQQAKTLPDTGMSHNDDLPYAELALGAGMAFLIRRFTKKDQQTEE

SEQ ID NO: 40566 - protein, 231 aa, Staphylococcus aureus; identical to SEQ ID NO: 33623
  subsp. aureus TCH130

SEQ ID NO: 40567 - protein, 291 aa, Staphylococcus aureus; identical to SEQ ID NO: 30390
  subsp. aureus TCH130

SEQ ID NO: 40568 - protein, 138 aa, Staphylococcus aureus; identical to SEQ ID NO: 34577
  subsp. aureus TCH130

SEQ ID NO: 40569 - protein, 68 aa, Staphylococcus aureus; identical to SEQ ID NO: 32241
  subsp. aureus TCH130

SEQ ID NO: 40570 - protein, 372 aa, Staphylococcus aureus
  subsp. aureus TCH130
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVVNNNEPTKEIKIANLEAQNSNQKKMNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHIYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 40571 - protein, 241 aa, Staphylococcus aureus
  subsp. aureus TCH130
MKKNIMNKLVLSTALLLLGTTSTQLPKTPISFSSEAKAYNISENETNINELIKYYTQPHLSLSNKWLWQKPNGSIHATLQTWVWYSHIQVFGSESWGNINQLRNKYVDIFGTKDEDTVEGYWTYDETFTGGVTPAATSSDKHYRLFLKYSDKQQTIIGGHEFYKGNKPVLTLKELDFRIRQTLIKNKKLYNGEFNKGQIKITADGNNYTIDLSKKLKLTDTNRYVKNPKNAQIEVILEKSN

SEQ ID NO: 40572 - protein, 241 aa, Staphylococcus aureus; identical to SEQ ID NO: 33879
  subsp. aureus TCH130

SEQ ID NO: 40573 - protein, 271 aa, Staphylococcus aureus
  subsp. aureus TCH130
MELIKIIANTILTSLTFKFLIPRIMIPLKGDVLMCKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 40574 - protein, 322 aa, Staphylococcus aureus; identical to SEQ ID NO: 38359
  subsp. aureus TCH130

SEQ ID NO: 40575 - protein, 165 aa, Staphylococcus aureus; identical to SEQ ID NO: 31315
  subsp. aureus TCH130

SEQ ID NO: 40576 - protein, 109 aa, Staphylococcus aureus
  subsp. aureus TCH130
MKKNFIGKSILSIAAISLTVSTFAGESHAQTKNAETVKKYNEYQTKFKKQVNKKVVDAQKAVNLFKRTRTVATHRKAQRAVNLIHFQHSYEKKKLQRQIDLVLKYNTLK

SEQ ID NO: 40577 - protein, 350 aa, Staphylococcus aureus; identical to SEQ ID NO: 30602
  subsp. aureus TCH130

SEQ ID NO: 40578 - protein, 644 aa, Staphylococcus aureus; identical to SEQ ID NO: 34627
  subsp. aureus TCH130

SEQ ID NO: 40579 - protein, 241 aa, Staphylococcus aureus; identical to SEQ ID NO: 31350
  subsp. aureus TCH130

SEQ ID NO: 40580 - protein, 488 aa, Staphylococcus aureus
  subsp. aureus TCH130
MMTLQIHTGGINLKKKNIYSIRKLGVGIASVTLGTLLISGGVTPAANAAQHDEAQQNAFYQVLNMPNLNADQRNGFIQSLKDDPSQSANVLGEAKKLNDSQAPKADAQQNNFNKDQQSAFYEILNMPNLNEVQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNNKPGKEDNNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40581 - protein, 681 aa, Staphylococcus aureus; identical to SEQ ID NO: 34632
  subsp. aureus TCH130

SEQ ID NO: 40582 - protein, 91 aa, Staphylococcus aureus; identical to SEQ ID NO: 38368
  subsp. aureus TCH130

SEQ ID NO: 40583 - protein, 618 aa, Staphylococcus aureus
  subsp. aureus TCH130
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIKSTNGDVVAKATYDILTKTYTFVFTDYVNEKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVDPEPSPDPEPEPTPDPEPSPDPEPEPTPDPEPSPDPDPEPTPDPEPSPDPDPDSDSDSDSESDSDS

SEQ ID NO: 40584 - protein, 75 aa, Staphylococcus aureus
  subsp. aureus TCH130
DSRVTPPNNEQKAPSNPKGEVNHSNKVSKQHKTDALPETGDKSENTNATLFGAMMALLGSLLLFRKRKQDHKEKA

SEQ ID NO: 40585 - protein, 233 aa, Staphylococcus aureus; identical to SEQ ID NO: 30428
  subsp. aureus TCH130

SEQ ID NO: 40586 - protein, 1035 aa, Staphylococcus aureus
  subsp. aureus TCH130
MHLKGDIIVKNNLRYGIRKHKLGAASVFLGTMIVVGMGQDKEAAASEQKTTTVEENGNSATDNKVNETQTTTTNVNTIDETQSFSATATEQPSNATQVTTEKAPKAVQAPQTAQPANFETVKEEVVKEEAKPQVETTQPQDNSGDQRQVDLTPKKTTQNQVAETQVEVAQPRTASESKPRVTRSADVVEAKEASDAKVETGTDVTSKVTVTESSIEGHNNTNKVEPHAGQRAVLKYKLKFENGLHQGDYFDFTLSNNVNTHGVSTARKVPEIKNGSVVMATGKILEGGKIRYTFTNDIEDKVDVTAELEINLFIDPKTVQTNGNQTITSTLNGEQTSKELDVKYKDGIGNYYANLNGSIETFNKANNRFTHVAFIKPNNGKTTSVTVTGTLMKGSNQNGNQPKVRVFEYLGNNEDIAKSVYANTTDTSKFKEVTSSMNGNLNVQTNGSYSLNLENLDKTYVVHYDGEYLNGTDEVDFRTQMVGHPEQLYKYYYDRGYTLTWDNGLVLYSNKANGNGKNGPIIQNNKFEYKEDTIKETLKGQYDKNLVTTVEEEYDSSTLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKDIVTGAVSDHTTIEDTKEYTTEINLIELVDELPEEHGQAQGPIEEITENNHHISHSGLGTENGHGNYGVIEEIEENSHVDIKSELGYEGGQNSGDQSFEEDTEEDKPKYEQGGNIVDIDFDSVPQIHGQNNGNQSFEEDTEKDKPKYEQGGNIIDIDFDSVPQIHGFNKHNEIIEEDTNKDKPNYQFGGHNSVDFEEDTLPKVSGQNEGQQTIEEDTTPPTPPAPEVPSEPGEPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKQKQSKKFELPGTGGEESTNKGMLFGGLFSILGLALLRRNKKNNKA

SEQ ID NO: 40587 - protein, 929 aa, Staphylococcus aureus
  subsp. aureus TCH130
MKSNLRYGIRKHKLGAASVFLGTMIVVGMGQEKEAAASEQNNTTVEESGSSATESKASETQTTTNNVNTIDETQSYSATSTEQPSQSTQVTTEEAPTTVQAPKVETSRVDLASEKVADKKTTGTQVDTAQPSNVSEIKPRMKRSTDVAEVAEKEVVEEAKATGTDVTSKVTVENGSEIVGHKQDTNVVNPHNAERVTLKYKWKFGEGIKAGDYFDFTLSDNVETHGISTLRKVPEIKSSTEDKVMANGQVIGERKIRYTFTDYIDNKKDLTAELTLNLFIDPTTVTKQGMEKVEVSLGQNKVSKEFDIKYLDGVKDRMGVTVNGRIDTLNKADGKFSHFAYVKPNNQSLSSVTVTGQVTSGYKQNVKNPTVKVYKHIGSDELAESIYAKLDDVSKFEDVTGELTLQYTSNGGYSLNFNNLDQSKNYVIKYEGDYDSNASTLEFQTHLFGYYNYYYYNTSNLTWKNGVAFYSNNAQGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEDSTKGIVTGAVSDHTTVEDTKEYTTESNLIELVDELPEEHGQAQGPIEEITENYQHISHSGLGTENGHGNYGVIEEIEENSHVDIKSELGYEGGQNSGNQSFEEDTEEDKPKYEQGGNIVDIDFDSVPQIQGQNNGDQSFEEDTEEDKPKYEQGGNIIDIDFDSVPHIHGFNKHTEIIEEDTNKDKPNYQFGGHSSVDFEEDTLPQVSGHNEGQQTIEEDTTPPIVPPTPPTPEVPSEPEVPTPPTSEIPSEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 40588 - protein, 429 aa, Staphylococcus aureus
  subsp. aureus TCH130
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKVWEANISDLGLDKSEAYNFLITSSQRQGTSQGVYANGWMRTDLNNSTFKLTPNLVKKTE

SEQ ID NO: 40589 - protein, 102 aa, Staphylococcus aureus
  subsp. aureus TCH130
PKDPKGPENPEKPSRPTHPSGPVNPDNPGLSKDRAKPNELVHSMDKNDKVKKSKIAKKSVANQEKKRAELPKTGAESTQKGLIFSSIIGIAGLMLLARRRKN

SEQ ID NO: 40590 - protein, 325 aa, Staphylococcus aureus; identical to SEQ ID NO: 30407
  subsp. aureus TCH130

SEQ ID NO: 40591 - protein, 315 aa, Staphylococcus aureus; identical to SEQ ID NO: 30573
  subsp. aureus TCH130

SEQ ID NO: 40592 - protein, 321 aa, Staphylococcus aureus; identical to SEQ ID NO: 30959
  subsp. aureus TCH130

SEQ ID NO: 40593 - protein, 141 aa, Staphylococcus aureus; identical to SEQ ID NO: 30633
  subsp. aureus TCH130

SEQ ID NO: 40594 - protein, 815 aa, Staphylococcus aureus
  subsp. aureus TCH130
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTDPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQHLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 40595 - protein, 2186 aa, Staphylococcus aureus
  subsp. aureus TCH130
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSKRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSADAKNYQAQGNVIALGRIKGNDTNDHGDFNGIEKTLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYQVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVRTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNLDRQQAIESIKQANTNAEVDQAATVAENNIDAVQVDVVKKQAARDKITAEVAKRIEAVKQTPNATDEEKQAAVNQINQLKDQAFNQINQNQTNDQVDTTTNQALKAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEETKVSPKEIQPAPKVCTPIKKEETHESRKVEKELPNTGSEGMDLPLKEFALITGAALLARRRTKNEKES

SEQ ID NO: 40596 - protein, 892 aa, Staphylococcus aureus; identical to SEQ ID NO: 34605
  subsp. aureus TCH130

SEQ ID NO: 40597 - protein, 79 aa, Staphylococcus aureus
  subsp. aureus TCH130
ATFYSETRKMTPITGGFANKTQNFEAVAQYQFDFGLRPSLGYVLSKGKDIEGIGDEDLVNYIDVGATYYFNKNMSAFVD

SEQ ID NO: 40598 - protein, 350 aa, Staphylococcus aureus
  subsp. aureus TCH130
MKNKKRVLIASSLSCAILLLSAATTQANSAHKDSQDQNKKEHVDKSQQKEKRNVTNKDKNSTVPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKEGQRLIVTYEVDWKNKTVKVVDKYSDNKSFREG

SEQ ID NO: 40599 - protein, 338 aa, Staphylococcus aureus; identical to SEQ ID NO: 34572
  subsp. aureus TCH130

SEQ ID NO: 40600 - protein, 275 aa, Staphylococcus aureus
  subsp. aureus TCH130
MHNHFWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 40601 - protein, 96 aa, Staphylococcus aureus; identical to SEQ ID NO: 31559
  subsp. aureus TCH130

SEQ ID NO: 40602 - protein, 691 aa, Staphylococcus aureus; identical to SEQ ID NO: 33577
  subsp. aureus TCH130

SEQ ID NO: 40603 - protein, 203 aa, Staphylococcus aureus; identical to SEQ ID NO: 31344
  subsp. aureus TCH130

SEQ ID NO: 40604 - protein, 226 aa, Staphylococcus aureus; identical to SEQ ID NO: 34596
  subsp. aureus TCH130

SEQ ID NO: 40605 - protein, 231 aa, Staphylococcus aureus; identical to SEQ ID NO: 34595
  subsp. aureus TCH130

SEQ ID NO: 40606 - protein, 369 aa, Staphylococcus aureus; identical to SEQ ID NO: 33375
  subsp. aureus TCH130

SEQ ID NO: 40607 - protein, 213 aa, Staphylococcus aureus
  subsp. aureus TCH130
MQSTKSDTPQSPTTKQVPTEINPKFKDLRAYYTKPSLEFKNEIGIILKKWTTIRFMNIVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKNNLYGNVGSGKIVIKMKNGGKYTFELHKKLQENRMADVIDGTNIDNIEVNIK

SEQ ID NO: 40608 - protein, 239 aa, Staphylococcus aureus
  subsp. aureus TCH130
MEHTTMKMTAIAKASLALGILATGTITSTHQTVNASEHEAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 40609 - protein, 231 aa, Staphylococcus aureus; identical to SEQ ID NO: 34063
  subsp. aureus TCH130

SEQ ID NO: 40610 - protein, 232 aa, Staphylococcus aureus; identical to SEQ ID NO: 34590
  subsp. aureus TCH130

SEQ ID NO: 40611 - protein, 232 aa, Staphylococcus aureus; identical to SEQ ID NO: 34589
  subsp. aureus TCH130

SEQ ID NO: 40612 - protein, 227 aa, Staphylococcus aureus; identical to SEQ ID NO: 31334
  subsp. aureus TCH130

SEQ ID NO: 40613 - protein, 227 aa, Staphylococcus aureus
  subsp. aureus TCH130
MKLKNITKASLALGILTTGMITTTAQPVKASTLEARSQATQDLKDYYNRPYFDLRNLSGYREGNTVTFINHYQQTDVKLEGKDKDKIKDGNNDNLDVFVVREGFGRQADNNSIGGITKTNGTQHKDTVQNVNLLVYKSTGQNTTSVTSTNYSIYKEEISLKELDFKLRKHLIDNNGLYNTEPKDSKIKVTMQNGDFYTFELNKKLQTHRMGDVIDGTKIKEINVELN

SEQ ID NO: 40614 - protein, 254 aa, Staphylococcus aureus; identical to SEQ ID NO: 33839
  subsp. aureus TCH130

SEQ ID NO: 40615 - protein, 239 aa, Staphylococcus aureus; identical to SEQ ID NO: 30622
  subsp. aureus TCH130

SEQ ID NO: 40616 - protein, 242 aa, Staphylococcus aureus; identical to SEQ ID NO: 30399
  subsp. aureus TCH130

SEQ ID NO: 40617 - protein, 238 aa, Staphylococcus aureus; identical to SEQ ID NO: 33836
  subsp. aureus TCH130

SEQ ID NO: 40618 - protein, 251 aa, Staphylococcus aureus; identical to SEQ ID NO: 33835
  subsp. aureus TCH130

SEQ ID NO: 40619 - protein, 258 aa, Staphylococcus aureus; identical to SEQ ID NO: 34610
  subsp. aureus TCH130

SEQ ID NO: 40620 - protein, 314 aa, Staphylococcus aureus; identical to SEQ ID NO: 36031
  subsp. aureus TCH130

SEQ ID NO: 40621 - protein, 327 aa, Staphylococcus aureus; identical to SEQ ID NO: 30616
  subsp. aureus TCH130

SEQ ID NO: 40622 - protein, 331 aa, Staphylococcus aureus; identical to SEQ ID NO: 34607
  subsp. aureus TCH130

SEQ ID NO: 40623 - protein, 1795 aa, Staphylococcus aureus; identical to SEQ ID NO: 30558
  subsp. aureus TCH70

SEQ ID NO: 40624 - protein, 231 aa, Staphylococcus aureus; identical to SEQ ID NO: 31073
  subsp. aureus TCH70

SEQ ID NO: 40625 - protein, 237 aa, Staphylococcus aureus
  subsp. aureus TCH70
MTSETNWKYEFKDLPKYDEGKKIEYTVTEDHVKDYTTDINGTTITNKYTPGETSATVTKNWDDNNNQDGKRPTEIKVELYQDGKATGKTATLNESNNWTHTWAGLDEKAKGQQVKYTVEELTKVKGYTTHVDNNDMGNLIVTNKYTPEKPNKPIYPEKPKDKTPPTKPDHSNKVKPTPPDKPSKVDKDDQPKDNKTKPENPLKELPKTGMKIITSWITWVFIGILGLYLILRKRFNS

SEQ ID NO: 40626 - protein, 681 aa, Staphylococcus aureus; identical to SEQ ID NO: 32025
  subsp. aureus TCH70

SEQ ID NO: 40627 - protein, 907 aa, Staphylococcus aureus; identical to SEQ ID NO: 31543
  subsp. aureus TCH70

SEQ ID NO: 40628 - protein, 198 aa, Staphylococcus aureus; identical to SEQ ID NO: 31544
  subsp. aureus TCH70

SEQ ID NO: 40629 - protein, 233 aa, Staphylococcus aureus; identical to SEQ ID NO: 30428
  subsp. aureus TCH70

SEQ ID NO: 40630 - protein, 1023 aa, Staphylococcus aureus; identical to SEQ ID NO: 36079
  subsp. aureus TCH70

SEQ ID NO: 40631 - protein, 943 aa, Staphylococcus aureus; identical to SEQ ID NO: 31546
  subsp. aureus TCH70

SEQ ID NO: 40632 - protein, 434 aa, Staphylococcus aureus
  subsp. aureus TCH70
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTETKTVE

SEQ ID NO: 40633 - protein, 141 aa, Staphylococcus aureus; identical to SEQ ID NO: 30633
  subsp. aureus TCH70

SEQ ID NO: 40634 - protein, 815 aa, Staphylococcus aureus; identical to SEQ ID NO: 31288
  subsp. aureus TCH70

SEQ ID NO: 40635 - protein, 75 aa, Staphylococcus aureus
  subsp. aureus TCH70
PGLSKDRAKPNEPVHSMDKNDKVKKSKIAKKSVANQEKKRAELPKTGAESTQKGLIFSSIIGIAGLMLLARRRKN

SEQ ID NO: 40636 - protein, 325 aa, Staphylococcus aureus; identical to SEQ ID NO: 30407
  subsp. aureus TCH70

SEQ ID NO: 40637 - protein, 315 aa, Staphylococcus aureus; identical to SEQ ID NO: 30573
  subsp. aureus TCH70

SEQ ID NO: 40638 - protein, 321 aa, Staphylococcus aureus; identical to SEQ ID NO: 30959
  subsp. aureus TCH70

SEQ ID NO: 40639 - protein, 528 aa, Staphylococcus aureus
  subsp. aureus TCH70
MNKNVLKFMVFIMLLNIITPLFNKNEALAARDISSTNVTDLTVSPTKIEDGGKTTVKMTFDDKSVKIQNGDTIKVAWPTSGTVKIEGYSKTVPLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGSNAITDFEKAFPGSKITVDNTKNTIDVTIPQGYGSYNSFSINYKTKITNEQQKEFVNNSQAWYQEHGKEEVNGKSFNHTVHNINANAGIEGTVKGELKVLKQDKDTKAPIANVKFKLSKKDGSVVKDNQKEIEIITDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGEDTTPEGYTKKENGLVVTNT

SEQ ID NO: 40640 - protein, 230 aa, Staphylococcus aureus; identical to SEQ ID NO: 31333
  subsp. aureus TCH70

SEQ ID NO: 40641 - protein, 227 aa, Staphylococcus aureus; identical to SEQ ID NO: 31334
  subsp. aureus TCH70

SEQ ID NO: 40642 - protein, 232 aa, Staphylococcus aureus; identical to SEQ ID NO: 31335
  subsp. aureus TCH70

SEQ ID NO: 40643 - protein, 234 aa, Staphylococcus aureus; identical to SEQ ID NO: 31336
  subsp. aureus TCH70

SEQ ID NO: 40644 - protein, 231 aa, Staphylococcus aureus; identical to SEQ ID NO: 31337
  subsp. aureus TCH70

SEQ ID NO: 40645 - protein, 232 aa, Staphylococcus aureus; identical to SEQ ID NO: 31338
  subsp. aureus TCH70

SEQ ID NO: 40646 - protein, 239 aa, Staphylococcus aureus; identical to SEQ ID NO: 36063
  subsp. aureus TCH70

SEQ ID NO: 40647 - protein, 320 aa, Staphylococcus aureus; identical to SEQ ID NO: 36064
  subsp. aureus TCH70

SEQ ID NO: 40648 - protein, 356 aa, Staphylococcus aureus; identical to SEQ ID NO: 31598
  subsp. aureus TCH70

SEQ ID NO: 40649 - protein, 251 aa, Staphylococcus aureus; identical to SEQ ID NO: 36066
  subsp. aureus TCH70

SEQ ID NO: 40650 - protein, 226 aa, Staphylococcus aureus; identical to SEQ ID NO: 31343
  subsp. aureus TCH70

SEQ ID NO: 40651 - protein, 203 aa, Staphylococcus aureus; identical to SEQ ID NO: 31344
  subsp. aureus TCH70

SEQ ID NO: 40652 - protein, 690 aa, Staphylococcus aureus; identical to SEQ ID NO: 31345
  subsp. aureus TCH70

SEQ ID NO: 40653 - protein, 241 aa, Staphylococcus aureus; identical to SEQ ID NO: 31350
  subsp. aureus TCH70

SEQ ID NO: 40654 - protein, 504 aa, Staphylococcus aureus
  subsp. aureus TCH70
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGNKPGKEDNNKPGKEDGNKPGKEDNKKPGKEDGNKPGKEDNNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40655 - protein, 62 aa, Staphylococcus aureus; identical to SEQ ID NO: 31608
  subsp. aureus TCH70

SEQ ID NO: 40656 - protein, 241 aa, Staphylococcus aureus; identical to SEQ ID NO: 30411
  subsp. aureus TCH70

SEQ ID NO: 40657 - protein, 314 aa, Staphylococcus aureus; identical to SEQ ID NO: 36031
  subsp. aureus TCH70

SEQ ID NO: 40658 - protein, 327 aa, Staphylococcus aureus; identical to SEQ ID NO: 30538
  subsp. aureus TCH70

SEQ ID NO: 40659 - protein, 331 aa, Staphylococcus aureus; identical to SEQ ID NO: 31305
  subsp. aureus TCH70

SEQ ID NO: 40660 - protein, 2186 aa, Staphylococcus aureus; identical to SEQ ID NO: 31566
  subsp. aureus TCH70

SEQ ID NO: 40661 - protein, 895 aa, Staphylococcus aureus; identical to SEQ ID NO: 31307
  subsp. aureus TCH70

SEQ ID NO: 40662 - protein, 312 aa, Staphylococcus aureus; identical to SEQ ID NO: 30196
  subsp. aureus TCH70

SEQ ID NO: 40663 - protein, 325 aa, Staphylococcus aureus; identical to SEQ ID NO: 30484
  subsp. aureus TCH70

SEQ ID NO: 40664 - protein, 372 aa, Staphylococcus aureus; identical to SEQ ID NO: 30609
  subsp. aureus TCH70

SEQ ID NO: 40665 - protein, 241 aa, Staphylococcus aureus; identical to SEQ ID NO: 31311
  subsp. aureus TCH70

SEQ ID NO: 40666 - protein, 241 aa, Staphylococcus aureus; identical to SEQ ID NO: 30739
  subsp. aureus TCH70

SEQ ID NO: 40667 - protein, 271 aa, Staphylococcus aureus; identical to SEQ ID NO: 36041
  subsp. aureus TCH70

SEQ ID NO: 40668 - protein, 322 aa, Staphylococcus aureus; identical to SEQ ID NO: 33409
  subsp. aureus TCH70

SEQ ID NO: 40669 - protein, 165 aa, Staphylococcus aureus; identical to SEQ ID NO: 31315
  subsp. aureus TCH70

SEQ ID NO: 40670 - protein, 105 aa, Staphylococcus aureus; identical to SEQ ID NO: 31317
  subsp. aureus TCH70

SEQ ID NO: 40671 - protein, 350 aa, Staphylococcus aureus; identical to SEQ ID NO: 30602
  subsp. aureus TCH70

SEQ ID NO: 40672 - protein, 645 aa, Staphylococcus aureus; identical to SEQ ID NO: 30747
  subsp. aureus TCH70

SEQ ID NO: 40673 - protein, 291 aa, Staphylococcus aureus; identical to SEQ ID NO: 30390
  subsp. aureus TCH70

SEQ ID NO: 40674 - protein, 946 aa, Staphylococcus aureus
  subsp. aureus TCH70
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVVNQAVNTSAPRMRAFSLSAVAADAPAAGKDITNQLTNVTVGIDSGDTVYPHQAGYVKLNYGFSVPNSAVKGDTFKITVPKELNLNGVTSTAKVPPIMAGDQVLANGVIDSDGNVIYTFTDYVDTKENVTANITMPAYIDPENVTKTGNVTLTTGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYDSRFVWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSESDSDSDSDSDSDSDSDSDSDSASDSDSDSDSDSDSDSDSDSDSDSDSDSDSDSDSDSDSDSESDSDSESDSDSDSDSDSDSDSDSDSASDSDSGSDSDSSSDSDSESDSNSDSESGSNNNVVPPNSPKNGTNASNKNEAKDSKEPLPDTGSEDEANTSLIWGLLASIGSLLLFRRKKENKDKK

SEQ ID NO: 40675 - protein, 240 aa, Staphylococcus aureus
  subsp. aureus TCH70
MKKRLLFVIVITLFIFSSNHTVLSNGDVGPGNLRNFYTKYEYVNLKNVKDKNSPESHRLEYSYKNDTLYAEFDNEYITSDLKGKNVDVFGISYKYGSNSRTIYGGITKAENNKLDSPRIIPINLIINGKHQTVTTKSVSTDKKMVTAQEIDVKLRKYLQDEFNIYGHNDTGKGKEYGTSSKFYSGFDKGSVVFHINDGSNFSYDLFYTGYGLPESFLKIYKDNKTVDSTQFHLDVEISKR

SEQ ID NO: 40676 - protein, 281 aa, Staphylococcus aureus
  subsp. aureus TCH70
MYLDTFWECWMKEIKMNKSRFISCVILIFALILVLFTPNVLAESQPDPTPDELHKSSEFTGTMGNMKYLYDDHYVSATKVKSVDKFLAHDLIYNISDKKLKNYDKVKTELLNEDLAKKYKDEVVDVYGSNYYVNCYFSSKDNVGKVTGGKTCMYGGITKHEGNHFDNGNLQNVLIRVYENKRNTISFEVQTDKKSVTAQELDIKARNFLINKKNLYEFNSSPYETGYIKFIENNGNTFWYDMMPAPGDKFDQSKYLMMYNDNKTVDSKRVKIEVHLTTKNG

SEQ ID NO: 40677 - protein, 434 aa, Staphylococcus aureus [sequence omitted]

SEQ ID NO: 40678 - protein, 234 aa, Staphylococcus aureus; identical to SEQ ID NO: 36037
  subsp. aureus TCH70

SEQ ID NO: 40679 - protein, 1141 aa, Staphylococcus aureus; identical to SEQ ID NO: 31329
  subsp. aureus TCH70

SEQ ID NO: 40680 - protein, 1347 aa, Staphylococcus aureus; identical to SEQ ID NO: 37757
  subsp. aureus TCH70

SEQ ID NO: 40681 - protein, 961 aa, Staphylococcus aureus; identical to SEQ ID NO: 37756
  subsp. aureus TCH70

SEQ ID NO: 40682 - protein, 350 aa, Staphylococcus aureus; identical to SEQ ID NO: 31291
  subsp. aureus TCH70

SEQ ID NO: 40683 - protein, 338 aa, Staphylococcus aureus; identical to SEQ ID NO: 31292
  subsp. aureus TCH70

SEQ ID NO: 40684 - protein, 274 aa, Staphylococcus aureus; identical to SEQ ID NO: 30872
  subsp. aureus TCH70

SEQ ID NO: 40685 - protein, 242 aa, Staphylococcus aureus; identical to SEQ ID NO: 31293
  subsp. aureus TCH70

SEQ ID NO: 40686 - protein, 244 aa, Staphylococcus aureus
  subsp. aureus TCH70
MKMNKIFRVLTVSLFFFTFLIKNNLAYADVGVINLRNFYANYQPEKLQGVSSGNFSTSHQLEYIDGKYTLYSQFHNEYEAKRLKDHKVDIFGISYSGLCNTKYMYGGITLANQNLDKPRNIPINLWVNGKQNTISTDKVSTQKKEVTAQEIDIKLRKYLQNEYNIYGFNKTKKGQEYGYKSKFNSGFNKGKITFHLNNEPSFTYDLFYTGTGQAESFLKIYNDNKTIDAENFHLDVEISYEKTE

SEQ ID NO: 40687 - protein, 257 aa, Staphylococcus aureus; identical to SEQ ID NO: 30259
  subsp. aureus TCH70

SEQ ID NO: 40688 - protein, 96 aa, Staphylococcus aureus; identical to SEQ ID NO: 31559
  subsp. aureus TCH70

SEQ ID NO: 40689 - protein, 96 aa, Staphylococcus aureus; identical to SEQ ID NO: 30813
  subsp. aureus USA300_TCH959

SEQ ID NO: 40690 - protein, 260 aa, Staphylococcus aureus
  subsp. aureus USA300_TCH959
MSKIKKITFILLSFIALTLITSPFVNCSEKSEEINGKDLQKKSELQGTALSNLRQTYYHNGSAIIENKESNDQFLKNTILFNDFFTGHQWYNDLLVDLGSKDTANIYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGYDLFGAQGQYPDTQLRIYRDNKTIKSKNMHIDIYLYTT

SEQ ID NO: 40691 - protein, 274 aa, Staphylococcus aureus
  subsp. aureus USA300_TCH959
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMFKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 40692 - protein, 338 aa, Staphylococcus aureus; identical to SEQ ID NO: 31292
  subsp. aureus USA300_TCH959

SEQ ID NO: 40693 - protein, 350 aa, Staphylococcus aureus
  subsp. aureus USA300_TCH959
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNPKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKEGQRLIVTYEVDWKNKTVKVVDKYTDNKSFREG

SEQ ID NO: 40694 - protein, 232 aa, Staphylococcus aureus
  subsp. aureus USA300_TCH959
MKLKNIAKASLALGILTTGMITTTAQPVKANEISSRLSVTSKDTQNLKTYYTGASFDLRGLSGYKEGDKVIFPQNGQQIDVTLTGKEGDVVQPNDDVTNVDVFAVPEGTGRSAIMTTIGGITTPNTQSYKDTTNNVNLRVSKSTSPNTTSVSVKKYDIFKEKISLKELDFKLRKHLIDNHDLYKTEPKDSKIIINMKDGGYYTFELNKKLQEHRMGDVIDGTKIKEINVELN

SEQ ID NO: 40695 - protein, 812 aa, Staphylococcus aureus
  subsp. aureus USA300_TCH959
MKKWQKLSTITLLMAGAITLNGGEFRSIDKNQIAVADTNVQTPDYEKLRNTWLDVNYGYDKYDEKNDAMKKKFEATENEAKKLLSEMKTESGRTYLWDSAKDLDNKSADMTRTYRNIEKIAEAMKHPKTTLNTDQNKNKVKDALEWLHKNAYGKEPTDKVKELTENFKITDSSKKKALNWWDYEIGTPKSLTNTLILLNGDISSDEKKKYTAPIKTFAPDSDKILSSVGQPEQAKGGNLVDITKVKLLESIIEEDKDMMKKSIDSFNKVFTYVQDSATDKDRNGFYKDGSYIDHKDVPYTGAYGVVLLEGISQMMPMIKETPFNDKTQNNTTLKSWIDDGFLPLIYKGEMMDLSRGRAISRENETSHSASATVMKSLLRLSDAMDDSTKAKYKKIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNKSKISIKKETHTGNWKEINKSQKDTQKTDEYYEVTQKHSNSDNKYGYVLYPGLSKDVFKSKASQVTVVKQEDDFHVVKDNESVWAGVNYSDSAKTFEINGTKVEVKTKGMFILKKKDDKTYECSFYNPESTNTASDIESKISMTGYSITNKNTSTSNESGVRFELQQTLNKDDN

SEQ ID NO: 40696 - protein, 141 aa, Staphylococcus aureus; identical to SEQ ID NO: 30633
  subsp. aureus USA300_TCH959

SEQ ID NO: 40697 - protein, 321 aa, Staphylococcus aureus; identical to SEQ ID NO: 30959
  subsp. aureus USA300_TCH959

SEQ ID NO: 40698 - protein, 318 aa, Staphylococcus aureus
  subsp. aureus USA300_TCH959
MKLMLKNKILATTLSVSLLAPLANPLLENAKAANDTEDIGKGSDIEIIKRTEDKTSNKWGVTQNIQFDFVKDKKYNKDALILKMQGFISSRTTYYNYKNTNHIKSMRWPFQYNIGLKTNDSNVSLINYLPKNKIESTNVSQTLGYNIGGNFQSAPSLGGNGSFNYSKSISYTQQNYVSEVEQQNSKSVLWGVKANSFVTASGQKSAFDSDLFVGYKPNSKDPRDYFVPDSELPPLVQSGFNPSFIATVSHEKGSGDTSEFEITYGRNMDVTHAIKRSTHYGNSYLDGHRVHNAFVNRNYTVKYEVNWKTHEIKVKGQN

SEQ ID NO: 40699 - protein, 325 aa, Staphylococcus aureus
  subsp. aureus USA300_TCH959
MKMNKLVKSSVTTSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 40700 - protein, 51 aa, Staphylococcus aureus
  subsp. aureus USA300_TCH959
MSVTKDHHNKAKALPETGSGNDESNNGTLFGGLFAALGSLLLFGRRKKQNK

SEQ ID NO: 40701 - protein, 81 aa, Staphylococcus aureus
  subsp. aureus USA300_TCH959
MVEIMKGSSPMRKKSGPINKRVDFLSNRLNKYSIRKFTIGTASILVGSTLIFGIGSGEAKADEKVYTNNENGTKSKHEKSE

SEQ ID NO: 40702 - protein, 314 aa, Staphylococcus aureus
  subsp. aureus USA300_TCH959
KEHGQAQGPIEEITENYQHISHSGLGTENGHGNYGVIEEIEENSHVDIKSELGYEGGQNSGNQSFEEDTEEDKPKYEQGGNIVDIDFDSVPQIHGQNNGDQSFEEDTEKDKPKYEQGGNIIDIDFDSVPHIHGFNKHNEIIEEDTNKDKPNYQFGGHNSVDFEEDTLPQVSGHNEGQQTIEEDTTPPIVPPTPPTPEVPIVPPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNHKA

SEQ ID NO: 40703 - protein, 543 aa, Staphylococcus aureus
  subsp. aureus USA300_TCH959
MKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVAVVAGEAKATGTDVTSKVKVTESSLEGHKQGTNVVNPHNAERVTLKYKWKFGEDIKPGDYFDFTLSNNVETHGISTLRKVPEIKSTDGQVMANGQVINERTIRYTFTDYINGKQNLTAELSLNLFIDPTTVTKKGKQKVEVSLGQNKISQEFDIQYLDGVKNPMGVTVNGRIHTLNKEEGKFSHFAYVKPNNQSLSSVTVTGQVTSGYKQDGGNPTVKVYKYTGKEGLAESVFADLSKNDQYEDITSQLSISYNNGGYTINFESLNNNKDYVIKYEGAYDAKSESLQLQTHLSAYNDYYYYPYYPVQLTWKNGVAFYSNNAQGDGKDKPNDPIIEKSEPIDLDIKSEPPVEKHELTGTIEESNDSKPIDFEYHTAVEGAEGHAEGIVETEEDSIHV

SEQ ID NO: 40704 - protein, 343 aa, Staphylococcus aureus
  subsp. aureus USA300_TCH959
EEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPHIHGFNKHTEIIEEDTNKDKPNYQFGGHNIVDFEEDTLPKVSGQNEGQQTIEEDTTPPTPPTPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 40705 - protein, 614 aa, Staphylococcus aureus
  subsp. aureus USA300_TCH959
MHLKGDIIVKNNLRYGIRKHKLGAASVFLGTMIVVGMGQDKEAAASEQKTTVEENGNSATDNKVSETQTTATNVNTIEETQSYNATVTEQPSNATQVTTEEAPNAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVTESSIEGHNNTNKVEPHAGQRAVLKYKLKFENGLHQGDYFDFTLSNNVNTHGVSTVRKVPDILNGSLVMATGKVLGEGKIRYTFTDYINNKVNVTANLEINLFIDPKTVQDNGNQKITSMINDHETEKTIPISYNPGVSNTYANINGSIETFNKADNKFTHVAYIIPKNGMSTESATITGTLMKGSNSNGNSPTVKIFEVLESNKELPKSVYANINDTNTFKDVTSQMKDNLTVSENGSYSLNIENLNKTYVVHYSGEYLSGSHEVDFRTQMTGHPKQQSIYYYNHGYTLTWDNGLVLYSNKANGDGKYGPIVDSNNFEFSEDSGNGSISGQYDAKQIIETEENQDNTPLDIDYHTAIDGEGGYVDGYIETIEETDSSAIDIDYHTAVDSEAGHVGGYTESSEESNPID

SEQ ID NO: 40706 - protein, 233 aa, Staphylococcus aureus
  subsp. aureus USA300_TCH959
MKKTIMASSLAVALGVTGYAAGTGHQAHAAEVNVDQAHLVDLAHNHQDQLNAAPIKDGAYDIHFVKDGFQYNFTSNGTTWSWSYEAANGQTTGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 40707 - protein, 90 aa, Staphylococcus aureus
  subsp. aureus USA300_TCH959
SDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 40708 - protein, 198 aa, Staphylococcus aureus; identical to SEQ ID NO: 31544
  subsp. aureus USA300_TCH959

SEQ ID NO: 40709 - protein, 683 aa, Staphylococcus aureus
  subsp. aureus USA300_TCH959
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRAVRSLAVAEPVVNAADAKGTNVNGQVTASDFKLEKTTFDPNQSGNTFMAAKFTVTGQVKAGDYFTAKLPDSVNGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTNEFKDKITYKYQNVASINFGDITKTYVVLVEGHYDNTGKNLKTQVIQENIDPATGKDYSIFGWNNENVVRYGGGSADGDSAVNPKDPTPGPPVAPEPSPDPEPEPTPDPEPSPEPDPEPTPDPEPSPDPDPDSDSDSESDSDSDSGSDSDSDSDSDSDSDSDSGSDSDSDSDSDSESDSDSDSDSDSESDSDSDSDSESDSDSDSDSDSDSDSDNDSDSDSDSE

SEQ ID NO: 40710 - protein, 2271 aa, Staphylococcus aureus
  subsp. aureus USA300_TCH959
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVFSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSESSSTSQSLSDSTSNAISTSESLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSLSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSASNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSVSDSTSLSDSVSDSTSDSTSMSISDSMSVSVSLSDSTSTSTSASEVMSASISDSQSMSESVNDSESESESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSTSQSTSVSTSLSTSDSISDSTSISISGSQSTVESESTSDSTSISDSESLSTSDSDSTSTSTSDSTSGSTSTSISESLSTSGSGSTSVSDSASMSESNSSSISMSQDKSDSTSISDSESVSTSTSTSLSTSDSTSTSESLSTSISGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 40711 - protein, 681 aa, Staphylococcus aureus
  subsp. aureus USA300_TCH959
MMKSQNKYSIRKFSVGASSILIATLLFLSGGQAQAAEKQVNMGNSQEDTVTARSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSLTKEAPSLNKSDQTNQREIVNETEIEKVQPQQNNQANDKITNHNFNNEQEVKPQKDEKTLSVSDLKNNQKSPVEPTKENDKKNGLNLLKSSAVATLPNKGTKELTAKAKDDQTNKVAKQGQYKNQDPIVLVHGFNGFTDDINSSVLAHYWGGNKMNIRQDLEENGYKVYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTNATDKIQKGIWQVTPTKHDWDHVDFVGQDSSDTVRTREELQDFWHHLADDLVKTEKVTDTKQA

SEQ ID NO: 40712 - protein, 520 aa, Staphylococcus aureus
  subsp. aureus USA300_TCH959
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLAEAKKLNESQAPKADNNFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDGNKPGKEDNKKPGKEDNNKPGKEDGNKPGKEDNKKPGKEDNNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40713 - protein, 241 aa, Staphylococcus aureus
  subsp. aureus USA300_TCH959
MKKLATVGSLIVTSTLVFSSMPFQNAHADTTSINVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHMNQQPHMQQGHMQSSNHQMMSPKANMHSSNHQMNQSNKKVLPAAGESMTSSILTASIAALLLVSGLFLAFRRRSTNK

SEQ ID NO: 40714 - protein, 690 aa, Staphylococcus aureus
  subsp. aureus USA300_TCH959
MLRGQEERKYSIRKYSIGVVSVLAATMFVVSSHEAQASEKTPTNAAAQKETLNQPGEQGNAITSHQMQSGKQLDDMHKENGKSGTVTEGKDTLQSSKHQSTQNSKTIRTQNDNQVKQDSERQGSKQSHQNNATNKTERQNDQVQNTHHAERNGSQSTTSQSNDVDKSQPSIPAQKVIPNHDKAAPTSTTPPSNDKTAPKSTKAQDATTDKHPNQQDTHQPVHQIIDAKQDDNVHQSEQKPQVGDLSKHIDGQNSPEKPTDKNTDNKQLIKDALQAPKTRSTTNATADAKKIRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFVRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 40715 - protein, 203 aa, Staphylococcus aureus
  subsp. aureus USA300_TCH959
MFKKYDSKNSILLKSILSLGIIYGGTFGIYPKADASTQNSSSVQDKQLQKVEEVPNNSEKALVKKLYDRYSKDTINGKSNKSRNWVYSERPLNENQVRIHLEGTYTVAGRVYTPKRNITLNKEVVTLKELDHIIRFAHISYGLYMGEHLPKGNIVINTKNGGKYTLESHKELQKNRENVEINTDDIKNVTFELVKSVNDIEQV

SEQ ID NO: 40716 - protein, 226 aa, Staphylococcus aureus
  subsp. aureus USA300_TCH959
MKFKAIAKASLALGMLATGVITSNVQSVQAKAEVKQQSESELKHYYNKPILERKNVTGYKYTEHGKDYIDVIVDNQYSQIALLGSDKDKFKDGENSNIDVFILREGDSRQATNYSIGGVTKSNSVQYIDYINTPILEIKKGKEEPQSSLYQIYKEDISLKELDFKLRKQLISQSGLYSKGLKQGRITITMNDGTTHTIDLSQKLEKERMGESIDGRQIQKILVEMK

SEQ ID NO: 40717 - protein, 231 aa, Staphylococcus aureus; identical to SEQ ID NO: 38266
  subsp. aureus USA300_TCH959

SEQ ID NO: 40718 - protein, 296 aa, Staphylococcus aureus
  subsp. aureus USA300_TCH959
ATTQAANTRQERTPKLEKAPNTNEEKTSTSKIEKISQPKQEAQKSLNISATPAPKQEQSQTTTESTTPKTKVTTPQSTNTPQPMQSTKSDTPQSPTIKQAQTDITPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVDHKAELKITKKDNQGMISRDVSEYMITKEEISLKELDFKLRKQLIEKHNLYGNMGSGTIVIKMKNGGKYTFELHKKLQEHRMADVIEGTNIDKIEVNIK

SEQ ID NO: 40719 - protein, 300 aa, Staphylococcus aureus
  subsp. aureus USA300_TCH959
MEHTTMKITTIAKTSLALGLLTTGVITTTTQAANATTPSSTKIEAPQQVANATTPSSTKVETPQQTPNAPTPPSTKVEAPQQAANATTPSSTKVEVPKQAANATTPSSTKVEAPQSKPNATTPPSSNVDTSPLQSPTTKQVPTEINPKFKDLRAYYTKPSLEFKNEIGIILKKWTTIRFMNIVPDYFIYKIALVGKDDKKYGEGVHRNVDVFVVLEENNYNLEKYSVGGITKSNSKKVDHKAGVRITKEDNKGIISHDVSEFKITKEQISLKELDFKLRKQLIEKIICTVTLVQVKLLLK

SEQ ID NO: 40720 - protein, 37 aa, Staphylococcus aureus
  subsp. aureus USA300_TCH959
MKNGGKYTFELHKKLQENRMADVIDGTNIDNIEVNIK

SEQ ID NO: 40721 - protein, 239 aa, Staphylococcus aureus
  subsp. aureus USA300_TCH959
MEHTTMKMTAIAKASLALGILATGTMTSLHQTVNASEHEAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 40722 - protein, 232 aa, Staphylococcus aureus
  subsp. aureus USA300_TCH959
MKLKTIAKATLALGLLATGVITTESQTVKAAESTQGQHNYKSLKYYYSKPSIELKNLDGLYRQHLTDKGAYVWKNLKDYYIGLLGEDSKKFKTDVYGDLDAFLVIEEEPVKGRQYSIGGISKTNSKEFKEREVDVKVTRKADKDTTSTKNSKFKITKEEISLKELDFKLRQKLMKEENLYDAINHRIGKIVVKMADDKFYTFELTKKLQPHRMGDTIDGTKIKEISVELEYK

SEQ ID NO: 40723 - protein, 231 aa, Staphylococcus aureus
  subsp. aureus USA300_TCH959
MKLKTLAKATLALGLLTTGVITSEGQAVQAKEKQERVQHLYDIKDLHRYYSSESFEFSNISGKVENYNGSNVVRFNQEKQNHQLFLLGKDKEEYKEGIEGKDVFVVKELIDPNGRVSTVGGVTKKNNQSSETNTPLFVKKVYGGDLDASIESFLINKEEVSLKELDFKIRQHLVKNYGLYKGTTKYGKITFNLKDGEKKEIDLGDKLQFEHMGDVLNSKDIQNIAVTINQI

SEQ ID NO: 40724 - protein, 232 aa, Staphylococcus aureus; identical to SEQ ID NO: 34809
  subsp. aureus USA300_TCH959

SEQ ID NO: 40725 - protein, 232 aa, Staphylococcus aureus
  subsp. aureus USA300_TCH959
MKFTALAKATLALGILTTGVFTAESQTGHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKMLVEKYRLYKGASDKGRIVINMKDEKKYVIDLSEKLSFDRMFDVMDSKKIKNIEVNLN

SEQ ID NO: 40726 - protein, 227 aa, Staphylococcus aureus
  subsp. aureus USA300_TCH959
MKFTALAKATLALGILTTGTLTTEFHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNISKEKGEDAFVKGYPYYIKKEKITLKELDYKLRKHLIEKYGLYKTISKDGRVKISLKDGSFYNLDLRSKLKFKYMGEVIESKQIKDIEVNLK

SEQ ID NO: 40727 - protein, 2480 aa, Staphylococcus aureus
  subsp. aureus USA300_TCH959
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGNQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKSDQFKYEVTLPQGVTYVNDSLTTTFPNGNEDSTVLKNMTVNYDQNANKVTFTSQGVTTARGTHTKEVLFPDKSLKLSYKVNVTNIDTPKNIDFNEKLTYRTASDVVINNAQPEVTLTADPFSVAVEMNKDALQQQVNSQVDNSHYTTASIAEYNKLKQQADTILNEDANHVETANRASQTDIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVIDKINAIQTQAKVKPAADTEVENAYNTRKQEIQNSNASTTEEKQAAYTELDTKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPQAKQAIADKVQAQETAIDANNGSTTEEKTAAKQQVQTEKTTADAAIDAAHTNAEVEAAKNAEIAKIEAIQPATTTKDNAKEAIATKANERKTAIAQTQDITAEEIAAANADVDNAVTQANSNIEAANSQNDVDQAKTTGETSIDQVTPTVNKKATARNEITTILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKENAIQAIDPIQASTDVKTNARAELLTEMQNKITEILSDNTTTNEEKGKDIEPVRATYEEGLNNINTANTTGDVTTAKDTAVQKVQQLHANPVKKPAGKTALDQAAADRKTQIEQTPNASQQEINDAKQEVDAALNQAKTNVDQSSTNEYVDNAVKEGKAKINAVKTFSEYKKDALAKIADAYNAKVNEADNSNASTSSEIAEAKQKLAELKQTADQNVNQATSKDDIEVQIHNDLDNINDYTIPTGKKETATTDLYAYADQKKNNISADTNATQDEKQQAIKQVDQNVQTALENINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTDNGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQTSVGPVANNKAKDMQTNDMKVSLATVSNGSNSANQDMLNVTNTDDHQAKTKSAQQGKVNKPKQQAKTLPDTGMSHNDDLPYAELALGAGMAFLIRRFTKKDQQTEE

SEQ ID NO: 40728 - protein, 231 aa, Staphylococcus aureus; identical to SEQ ID NO: 30630
  subsp. aureus USA300_TCH959

SEQ ID NO: 40729 - protein, 717 aa, Staphylococcus aureus
  subsp. aureus USA300_TCH959
MNNKKTATNRKGMISNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNTTANQSTTQTSNVTTNDKSATTYSNETSKSNLTQAKDVSTKPKTTTIKPRTLNRMAVNTVAAPQQGTNVNDKVHFKNIDIAIDKGHVNKDTGKTEFWATSSDVLKLKANYTIDDSVKEGDTFTFKYGQYFRPGSVRLPSKTQNLYNAQGNIIAKGIYDSATNSTTYTFTNYVDQYTNISGSIEQVSFAKRENATTDKTAYKMEVTLGNDSYSKEVIVDYGNKKAQPLISSTNYINNEDLSRNMTAYVNQPKNTYTKQTFVTNLTGYKFNPNAKNFKIYEVTNQNQFVDSFTPDTSKLTDVTDQFDINYSNDNKTATVDLMKGQKSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAIDSDGLTTTGVIKDADNMTLDSGFYKTPKYSLGDYVWYDSNKDGKQDSTEKGIKGVKVTLQNEKGEVIGTTETDSNGKYRFDNLDSGKYKVIFEKPAGLTQTGTNTTEDDKDADGGEVDVTITDHDDFTLDNGYYEEET

SEQ ID NO: 40730 - protein, 101 aa, Staphylococcus aureus
  subsp. aureus USA300_TCH959
DSDSDSDSDSDSDSDSDSDSDSDSDSDSDSDSDSDSDSDSDAGKHIPAKPMSTVKDHHNKAKALPETGSENNNSNNGTLFGGLFAALGSLLLFGRRKKQNK

SEQ ID NO: 40731 - protein, 1148 aa, Staphylococcus aureus
  subsp. aureus USA300_TCH959
MLNRENKTAMTRKGMVSNRLNKFSIRKYTVGTASILVGTTLIFGLGNQEAKAAESTNKELNETTTSASDNQSNSKVDNQQLNQEDNTKNDNQKEMESSQGTETTSNDNKALSLENGSVQSTTGNKVEVSTAKSDEQAPPKSTNEDLNTKQTISNQEALQPDLQENKSVVNVQPTNEENKKVDAKTESTTLNVKSDAIKSNAETLVDNNSNSNNENNADIILPKSTAPKRLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYYEEETSDSDSDSDSDSDSDSDSDSDSDS

SEQ ID NO: 40732 - protein, 60 aa, Staphylococcus aureus
  subsp. aureus USA300_TCH959
AGKHTPVKPMSATKDHDNKAKALPETGNENSGSNNATLFGGLFAALGSLLLFGRRKKQNK

SEQ ID NO: 40733 - protein, 942 aa, Staphylococcus aureus
  subsp. aureus USA300_TCH959
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRLNAKMRFAVAQPAAVASNNVNDLITVTKQTITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDNNTEIKVYKVAPGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPTGYLPTKVNGTTDGEKDSNGSSVTVKINGKDDMSLDTGFYKEPKYNLGDYVWEDANKDGIQDANEPGIKDVKVTLKDSTGKVIGTTTTDASGKYKFTDLDNGNYTVEFETPAGYTPTVKNTTADDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYYEEETSDSDSDS

SEQ ID NO: 40734 - protein, 83 aa, Staphylococcus aureus
  subsp. aureus USA300_TCH959
DSDSDSDSDSDSDSDLDSDSDSDSGKHTPVKPMSTTKDHHNKAKALPETGSENNGSNNATLFGGLFAALGSLLLFGRRKKQNK

SEQ ID NO: 40735 - protein, 434 aa, Staphylococcus aureus [sequence omitted]

SEQ ID NO: 40736 - protein, 583 aa, Staphylococcus aureus
  subsp. aureus USA300_TCH959
MNMKKKEKHAIRKKSIGVASVLVGTLIGFGLLSSKEADASENSVTQSDSASNESKSNDSSSVSAAPKTDDTNVSDTKTSSNTNNGETSVAQNLAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVTKTGNVTLATGIGNTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGS

SEQ ID NO: 40737 - protein, 641 aa, Staphylococcus aureus
  subsp. aureus USA300_TCH959
MNKQQKEFKSFYSIRKSSLGVASVAISTLLLLMSNGEAQAAEETGGTNTEAQPKTEAVASPTTTTEKAPEAKPVANAVSVSNKEVEAPTSETKEAKEVKAPKETKAVKPAAKADNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPAKGEVESSSTTPTKVVSTTQNVVKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 40738 - protein, 350 aa, Staphylococcus aureus
  subsp. aureus USA300_TCH959
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSYNKSQQTNKVTKHNETPKQASKAKELPKTGLTSVDNFISTVAFATLALLGSLSLLLFKRKESK

SEQ ID NO: 40739 - protein, 105 aa, Staphylococcus aureus; identical to SEQ ID NO: 33600
  subsp. aureus USA300_TCH959

SEQ ID NO: 40740 - protein, 165 aa, Staphylococcus aureus; identical to SEQ ID NO: 31315
  subsp. aureus USA300_TCH959

SEQ ID NO: 40741 - protein, 322 aa, Staphylococcus aureus
  subsp. aureus USA300_TCH959
MMKMKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKASKQQTNIDVIYERVRDDYQLHWTSTNWKGTNTKDKWTDRSSERYKIDWENEEMTN

SEQ ID NO: 40742 - protein, 271 aa, Staphylococcus aureus; identical to SEQ ID NO: 40573
  subsp. aureus USA300_TCH959

SEQ ID NO: 40743 - protein, 241 aa, Staphylococcus aureus
  subsp. aureus USA300_TCH959
MNNNITKKIILSTTLLLLGTAFTQFPNTPINSSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 40744 - protein, 241 aa, Staphylococcus aureus; identical to SEQ ID NO: 30608
  subsp. aureus USA300_TCH959

SEQ ID NO: 40745 - protein, 372 aa, Staphylococcus aureus
  subsp. aureus USA300_TCH959
MNKQQSKVRYSIRKVSIGILSISIGMFLALGMSNKAYADEIDKSKDFTRGYEQNVFAKSELNANKNTTNDKIKNEGAVKTSDTSLKLDNKSAISNGNEINQDIKISNTPKNSSQGNNLVVNNNEPTKEIKIANLEVQNSNQKKMNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 40746 - protein, 68 aa, Staphylococcus aureus; identical to SEQ ID NO: 32241
  subsp. aureus USA300_TCH959

SEQ ID NO: 40747 - protein, 138 aa, Staphylococcus aureus; identical to SEQ ID NO: 30785
  subsp. aureus USA300_TCH959

SEQ ID NO: 40748 - protein, 291 aa, Staphylococcus aureus; identical to SEQ ID NO: 30390
  subsp. aureus USA300_TCH959

SEQ ID NO: 40749 - protein, 893 aa, Staphylococcus aureus
  subsp. aureus USA300_TCH959
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNTSMINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEDKVADTDVAENSSTATNPKDASDKADVIEPESDMVKDTDSSVDKDVQHDVDHLSDMLDNNHFDKYDLKEMDTQIAKDTDKGVDNSVGMSSNVDTDKDSNKNKDKVIQLAHIADKNKVNNTGTETNIDTMKYHPISTIKVTDKKATEHLPSDIHKTVDKTVKTKEKAGTPSKENKLSQSKMLPKTGETTSSQSWWGLYALLGMLALLIPKFRKESK

SEQ ID NO: 40750 - protein, 1910 aa, Staphylococcus aureus
  subsp. aureus USA300_TCH959
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDAVSNNTTLNVPNKTNENGSGGHLTLKEIQEDVRHSSDKPELVAIAEPASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDNKNYQAQGNVIALGRINGTDTNDHGDFNGIEKTLTVNPNSELIFEFNTMTTKNGQGATNVIIKNADTNDTIAEKTVEGGPTLRLFKVPDNVRNLKIQFVSKNDAITDARGIYQLKDGYKYYSFVDSIGLHSGSHVYVERRTMEPTATNNKEFTVTTSLKNNGNSGASLDTDEFVYKIQLPEGVEYVNNSLTKDFPSNNSGVDVNDMNVTYDAANRVITIKSTGGGTTNSPARLMPDKILDLKYKLRVNNVPTPRTVTFNDTLTYKTYTQDFINSAAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGMQNIVVIQPATQVKTDARNTVNEKAREAITNINATPGATREEKQEAIDRVNALKNRALTDIGVTSTTAMVNSIRDDAVNQIGAVQPHVTKKQTATGVLNDLATAKKQEINQNTNATTEEKQMALNQVDQDLATAINNINQADTNTEVDQAQQLGAQAINAIQPNIVKKPAALAQINQHYNAKLAEINATPDATDDEKNAAINTLNQDRQQAIESVKQANTNNEVDQAATTAENNIDAVQVDVVKKQAARDKITAEVAKRIEAVKQTPNATDEEKQAAVNQINQLKDQAFNQINQNQTNDQVDTTTNQALNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEA

SEQ ID NO: 40751 - protein, 331 aa, Staphylococcus aureus
  subsp. aureus USA300_TCH959
MSNQFKSEEERRQWEQFQAFQNQQNQQNQQYGQKKSKKGWFWGCGGCLLLFILIIIGISACTAGITGNLGGNSSKETNKTHKIGETVKNGDLEVTVNSVETMKSVGPSLAPTNAKGTFVVADVTIKNKGKEALTIDSSMFKLKSSDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVNYEASATTPATTSSADTDSEDSEKSSKDEDKQNASKSDKSSVEKSESNEETATVEPMPQSKPTTSEAPPSQNIHNEDSMYDASTE

SEQ ID NO: 40752 - protein, 806 aa, Staphylococcus aureus
  subsp. aureus USA300_TCH959
MTYKMKKWQKLSTITLLMVGVITLNNGEFRNVDKHQIAVADTNVQTPDYEKLKKTWLDVNYGYDQYDENNQDMKKKFDATEKEAEKLLKEMKTESDRKYLWENSKDLDTKSADMTRTYRNIEKIAEAMKHKDTKLKTDENKKKVKDALDWLHENAYGKEPDKKVKELTENFKITDSSKKKALNWWDYEIGTPRALTNTLILLNGDISSDEKKKYTAPIKTFAPDSDKILSSVGKPEQAKGGNLVDITKVKLLESIIEEDETMMKNSIDSFNKAFTYVQDSATGKARNGFYKDGSYIDHQDVPYTGAYGVVLLEGISQIFPMIKETPFKTTQDNATLSNWIYEGFMPLIYKGEMMDLSRGRAISRENETSHTASATVMKSLLRLSDTMDDSTKTKYKQIVKTSVDSDSSYNQNDYLNSYSDIDKMKKLIDDKSITKNDLTQQLKIYNDMDRVTYHNKDLDFAFGLSMTSKNVARYESINNENLKGWHTGAGMSYLYNSDVKHYRDNFWATADMTRLPGTTTLNDMPSTNTKNDNSFVGGTKLNNKYASIGMDFENQDKILTAKKSYFILNDKIVFLGTGIKSTDSSKNPVTSVENRKANGYKLYKDDIEITTSDVNAQETHSVFLESNDTKKNIGYHFLDKPKITIKKESHTGKWSEINKSQKPDDKKDEYYEVTQTHNTSDSKYAYVLYPGLSKSDFKPKNNNVSILKQDEDFHVIKDNDGVFAGVNYSDSTKIFDIDGTTVELKEKGMFVIKKKDDNTYECSFYNPTSTNSTSNIESKISMTGYSITNKNTSTSNESGARYELTK

SEQ ID NO: 40753 - protein, 327 aa, Staphylococcus aureus; identical to SEQ ID NO: 34061
  subsp. aureus USA300_TCH959

SEQ ID NO: 40754 - protein, 311 aa, Staphylococcus aureus
  subsp. aureus USA300_TCH959
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHERGSSDTSEFEISYGRNLDITYATLFPRTGIYAERKHNAFVNRNFVVRYEVNWKTHEIKVKGHN

SEQ ID NO: 40755 - protein, 434 aa, Staphylococcus aureus [sequence omitted]

SEQ ID NO: 40756 - protein, 927 aa, Staphylococcus aureus
  subsp. aureus VC40
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPVAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSDLDSDSDSDSDSDSDSDSASDSDSGSDSDSSSDSDSESDSNSDSESVSNNNVVPPNSPKNGTNASNKNEAKDSKEPLPDTGSEDEANTSLIWGLLASIGSLLLFRRKKENKDKK

SEQ ID NO: 40757 - protein, 684 aa, Staphylococcus aureus; identical to SEQ ID NO: 30722
  subsp. aureus VC40

SEQ ID NO: 40758 - protein, 274 aa, Staphylococcus aureus; identical to SEQ ID NO: 30872
  subsp. aureus VC40

SEQ ID NO: 40759 - protein, 338 aa, Staphylococcus aureus; identical to SEQ ID NO: 30699
  subsp. aureus VC40

SEQ ID NO: 40760 - protein, 351 aa, Staphylococcus aureus; identical to SEQ ID NO: 30720
  subsp. aureus VC40

SEQ ID NO: 40761 - protein, 26 aa, Staphylococcus aureus
  subsp. aureus VC40
MAQDIISTIGDLVKWIIDTVNKFTKK

SEQ ID NO: 40762 - protein, 231 aa, Staphylococcus aureus; identical to SEQ ID NO: 31073
  subsp. aureus VC40

SEQ ID NO: 40763 - protein, 645 aa, Staphylococcus aureus; identical to SEQ ID NO: 30747
  subsp. aureus VC40

SEQ ID NO: 40764 - protein, 350 aa, Staphylococcus aureus; identical to SEQ ID NO: 30602
  subsp. aureus VC40

SEQ ID NO: 40765 - protein, 2478 aa, Staphylococcus aureus; identical to SEQ ID NO: 31716
  subsp. aureus VC40

SEQ ID NO: 40766 - protein, 807 aa, Staphylococcus aureus; identical to SEQ ID NO: 30716
  subsp. aureus VC40

SEQ ID NO: 40767 - protein, 141 aa, Staphylococcus aureus; identical to SEQ ID NO: 30715
  subsp. aureus VC40

SEQ ID NO: 40768 - protein, 516 aa, Staphylococcus aureus; identical to SEQ ID NO: 31703
  subsp. aureus VC40

SEQ ID NO: 40769 - protein, 52 aa, Staphylococcus aureus; identical to SEQ ID NO: 33765
  subsp. aureus VC40

SEQ ID NO: 40770 - protein, 109 aa, Staphylococcus aureus; identical to SEQ ID NO: 30744
  subsp. aureus VC40

SEQ ID NO: 40771 - protein, 165 aa, Staphylococcus aureus; identical to SEQ ID NO: 30742
  subsp. aureus VC40

SEQ ID NO: 40772 - protein, 319 aa, Staphylococcus aureus; identical to SEQ ID NO: 30741
  subsp. aureus VC40

SEQ ID NO: 40773 - protein, 238 aa, Staphylococcus aureus; identical to SEQ ID NO: 30740
  subsp. aureus VC40

SEQ ID NO: 40774 - protein, 241 aa, Staphylococcus aureus; identical to SEQ ID NO: 30739
  subsp. aureus VC40

SEQ ID NO: 40775 - protein, 241 aa, Staphylococcus aureus; identical to SEQ ID NO: 30738
  subsp. aureus VC40

SEQ ID NO: 40776 - protein, 372 aa, Staphylococcus aureus; identical to SEQ ID NO: 31084
  subsp. aureus VC40

SEQ ID NO: 40777 - protein, 309 aa, Staphylococcus aureus; identical to SEQ ID NO: 30406
  subsp. aureus VC40

SEQ ID NO: 40778 - protein, 315 aa, Staphylococcus aureus; identical to SEQ ID NO: 30440
  subsp. aureus VC40

SEQ ID NO: 40779 - protein, 325 aa, Staphylococcus aureus; identical to SEQ ID NO: 30407
  subsp. aureus VC40

SEQ ID NO: 40780 - protein, 690 aa, Staphylococcus aureus; identical to SEQ ID NO: 30419
  subsp. aureus VC40

SEQ ID NO: 40781 - protein, 203 aa, Staphylococcus aureus; identical to SEQ ID NO: 30770
  subsp. aureus VC40

SEQ ID NO: 40782 - protein, 1627 aa, Staphylococcus aureus
  subsp. aureus VC40
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQSVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 40783 - protein, 940 aa, Staphylococcus aureus; identical to SEQ ID NO: 30465
  subsp. aureus VC40

SEQ ID NO: 40784 - protein, 1018 aa, Staphylococcus aureus; identical to SEQ ID NO: 31704
  subsp. aureus VC40

SEQ ID NO: 40785 - protein, 226 aa, Staphylococcus aureus
  subsp. aureus VC40
MKFKAIAKASLALGMLATGVITSNVQSVQAKAEVKQQSESELKHYYNKPILERKNVTGFKYTDEGKHYLEVTVGQQHSRITLLGSDKDKFKDGENSNIDVFILREGDSRQATNYSIGGVTKSNSVQYIDYINTSILEIKKDNEDVLKDFYYISKEDISLKELDYRLRERAIKQHGLYSNGLKQGQITITMNDGTTHTIDLSQKLEKERMGESIDGTKINKILVEMK

SEQ ID NO: 40786 - protein, 231 aa, Staphylococcus aureus; identical to SEQ ID NO: 30768
  subsp. aureus VC40

SEQ ID NO: 40787 - protein, 356 aa, Staphylococcus aureus; identical to SEQ ID NO: 31755
  subsp. aureus VC40

SEQ ID NO: 40788 - protein, 308 aa, Staphylococcus aureus; identical to SEQ ID NO: 31763
  subsp. aureus VC40

SEQ ID NO: 40789 - protein, 234 aa, Staphylococcus aureus; identical to SEQ ID NO: 31052
  subsp. aureus VC40

SEQ ID NO: 40790 - protein, 231 aa, Staphylococcus aureus; identical to SEQ ID NO: 31761
  subsp. aureus VC40

SEQ ID NO: 40791 - protein, 231 aa, Staphylococcus aureus; identical to SEQ ID NO: 30560
  subsp. aureus VC40

SEQ ID NO: 40792 - protein, 232 aa, Staphylococcus aureus; identical to SEQ ID NO: 31054
  subsp. aureus VC40

SEQ ID NO: 40793 - protein, 232 aa, Staphylococcus aureus; identical to SEQ ID NO: 30765
  subsp. aureus VC40

SEQ ID NO: 40794 - protein, 227 aa, Staphylococcus aureus; identical to SEQ ID NO: 30585
  subsp. aureus VC40

SEQ ID NO: 40795 - protein, 225 aa, Staphylococcus aureus; identical to SEQ ID NO: 30763
  subsp. aureus VC40

SEQ ID NO: 40796 - protein, 233 aa, Staphylococcus aureus; identical to SEQ ID NO: 30428
  subsp. aureus VC40

SEQ ID NO: 40797 - protein, 995 aa, Staphylococcus aureus; identical to SEQ ID NO: 31752
  subsp. aureus VC40

SEQ ID NO: 40798 - protein, 1349 aa, Staphylococcus aureus; identical to SEQ ID NO: 31751
  subsp. aureus VC40

SEQ ID NO: 40799 - protein, 234 aa, Staphylococcus aureus; identical to SEQ ID NO: 30736
  subsp. aureus VC40

SEQ ID NO: 40800 - protein, 877 aa, Staphylococcus aureus; identical to SEQ ID NO: 31708
  subsp. aureus VC40

SEQ ID NO: 40801 - protein, 2271 aa, Staphylococcus aureus; identical to SEQ ID NO: 31839
  subsp. aureus VC40

SEQ ID NO: 40802 - protein, 681 aa, Staphylococcus aureus; identical to SEQ ID NO: 32025
  subsp. aureus VC40

SEQ ID NO: 40803 - protein, 291 aa, Staphylococcus aureus; identical to SEQ ID NO: 30390
  subsp. aureus VC40

SEQ ID NO: 40804 - protein, 895 aa, Staphylococcus aureus; identical to SEQ ID NO: 31734
  subsp. aureus VC40

SEQ ID NO: 40805 - protein, 2186 aa, Staphylococcus aureus; identical to SEQ ID NO: 31733
  subsp. aureus VC40

SEQ ID NO: 40806 - protein, 331 aa, Staphylococcus aureus; identical to SEQ ID NO: 30732
  subsp. aureus VC40

SEQ ID NO: 40807 - protein, 327 aa, Staphylococcus aureus; identical to SEQ ID NO: 30538
  subsp. aureus VC40

SEQ ID NO: 40808 - protein, 306 aa, Staphylococcus aureus; identical to SEQ ID NO: 30803
  subsp. aureus VC40

SEQ ID NO: 40809 - protein, 231 aa, Staphylococcus aureus; identical to SEQ ID NO: 33623
  subsp. aureus VCU006

SEQ ID NO: 40810 - protein, 807 aa, Staphylococcus aureus
  subsp. aureus VCU006
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYRDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 40811 - protein, 141 aa, Staphylococcus aureus; identical to SEQ ID NO: 30715
  subsp. aureus VCU006

SEQ ID NO: 40812 - protein, 995 aa, Staphylococcus aureus
  subsp. aureus VCU006
MNNKKTATNRKGMISNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNTTANQSTTQTSNVTTNDKSATTYSNDTSKSNLTQAKDVSTKPKTTTIKPRTLNRMAVNTVAAPQQGTNVNDKVHFKNIDIAIDKGHVNKDTGKTEFWATSSDVLKLKANYTIDDSVKEGDTFTFKYGQYFRPGSVRLPSKTQNLYNAQGNIIAKGIYDSATNSTTYTFTNYVDQYTNISGSIEQVSFAKRENATTDKTAYKMEVTLGNDSYSKEVIVDYGNKKAQPLISSTNYINNEDLSRNMTAYVNQPKNTYTKQTFVTNLTGYKFNPNAKNFKIYEVTNQNQFVDSFTPDTSKLTDVTDQFDINYSNDNKTATVDLMKGQKSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAIDSDGLTTTGVIKDADNMTLDSGFYKTPKYSLGDYVWYDSNKDGKQDSTEKGIKGVKVTLQNEKGEVIGTTETDSNGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHIPAKPMSTVKDHHNKAKALPETGSENNNSNNGTLFGGLFAALGSLLLFGRRKKQNK

SEQ ID NO: 40813 - protein, 1399 aa, Staphylococcus aureus; identical to SEQ ID NO: 38277
  subsp. aureus VCU006

SEQ ID NO: 40814 - protein, 1079 aa, Staphylococcus aureus
  subsp. aureus VCU006
MINRDNKKAITKKGMISNRLNKFSIRKYTVGTASILVGTTLIFGLGNQEAKAAENTSTENAKQDDATTSDNKEVVSETENNSTTENNSTNPIKKETNTDSQPEAKKESTSSSTQKQQNNVTATTETKPQNIEKENVKPSTDKTATEDTSVILEEKKAPNNTNNDVTTKPSTSEIQTKPTTPQESTNIENSQPQPTPSKVDNQVTDATNPKQTVNVSKEDLKNDPEKLKELVRSENNTNHSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 40815 - protein, 321 aa, Staphylococcus aureus; identical to SEQ ID NO: 30959
  subsp. aureus VCU006

SEQ ID NO: 40816 - protein, 315 aa, Staphylococcus aureus; identical to SEQ ID NO: 30573
  subsp. aureus VCU006

SEQ ID NO: 40817 - protein, 325 aa, Staphylococcus aureus; identical to SEQ ID NO: 30407
  subsp. aureus VCU006

SEQ ID NO: 40818 - protein, 107 aa, Staphylococcus aureus; identical to SEQ ID NO: 35348
  subsp. aureus VCU006

SEQ ID NO: 40819 - protein, 2446 aa, Staphylococcus aureus
  subsp. aureus VCU006
MNLFRQQKFSIRKFNVGIFSALIATVTFISTNPTTASAAEQNQPAQNQPAQPADANTQPNANAGAQANPAAQPANQGGQANPAGGAAQPNTQPAGQGNQADPNNAAQAQPGNQATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDAKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTAPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVEAAQKQGLHDIQVVKSKQEVADTKSKVLDKINAIQTQAKVKPAADTEVENAYNTRKQEIQNSNASTTEEKQAAYTELDAKKQEARTNLDAANTNSDVTTAKDNGIAAINQVQAATTKKSDAKAEIAQKASERKTAIEAMNDSTTEEQQAAKDKVDQVVVTANADIDNAAANADVDNAKTTNEATIAAITPDANVKPTAKQAIADKVQAQETAIDANNGATTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQAIQATPDATNEEKQAADAEANTENGKAIQAIAAATTNADVDEAKANAEAAINAVTPKVVKKQAAKDEIDQLQATQTNVINNDQNATNEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTADVTTAKDTAVQKVQQLHANPVKKPAGKKELDQAAADKKTQIEQTPNASQQEINDAKQEIDTELNQAKTNVDQSSTNEYVDNAVKEGKAKINAVKTFSEYKKDALAKIADAYNAKVNEADNSNASTSSEIAEAKQKLAELKQTTDQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPKVESTNNGTTDKPVTETDNATPAESTTNNNSTTTATNENAPTGSTTTAPTTASTEAASSADSKDNASVNDSKQNAEVNNSAESQSTNGKVAQPKSENKAKAEKDGRDSTNQSMVESTTETLPSADITEPNVPSNTSKDKEESTSNQTDAGQPKSETNVASNEADKSPSKADTEVSNKPSTSASSEAKDKMTSTNVSQKDDTATADTNDTQTSVGPDANNKAMQNGGANASSATVSNGSHSMHQDMLKVTNTDDHQAKTKSAQQGKVNKPKQQAKTLPDTGMSHNDDLPYAELALGAGMAFLIRRFTKKDQQTEE

SEQ ID NO: 40820 - protein, 232 aa, Staphylococcus aureus; identical to SEQ ID NO: 35426
  subsp. aureus VCU006

SEQ ID NO: 40821 - protein, 232 aa, Staphylococcus aureus; identical to SEQ ID NO: 38273
  subsp. aureus VCU006

SEQ ID NO: 40822 - protein, 164 aa, Staphylococcus aureus
  subsp. aureus VCU006
MKLTAIAKAALALGILTTGTLTTEVHSGHAKQNQKSVNKHDKEALYRYYTGKTMEMKNISALKHGKNNLRFKYRGMKIQVLLLGNDKNRFQQRSYKGLDVFFVQEKRDKHDIFYTVSGVIQTNKTSGVVSAPILNVTKEKGEDAFVKGYPYYIKKKNNIKRVRF

SEQ ID NO: 40823 - protein, 61 aa, Staphylococcus aureus; identical to SEQ ID NO: 33840
  subsp. aureus VCU006

SEQ ID NO: 40824 - protein, 233 aa, Staphylococcus aureus; identical to SEQ ID NO: 38275
  subsp. aureus VCU006

SEQ ID NO: 40825 - protein, 403 aa, Staphylococcus aureus
  subsp. aureus VCU006
MPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDNNKPGKEDNKKPGKEDNNKPGKEDNNKPGKEDNNKPGKEDGNKPGKEDNKKPGKEDNNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 40826 - protein, 73 aa, Staphylococcus aureus
  subsp. aureus VCU006
MKKKNIYSIRKLGVGIASVTLGTLLISGGVTPAANAAQHDEAQQNAFYQVLNMPNLNADQRNGFIQSLKDDPS

SEQ ID NO: 40827 - protein, 241 aa, Staphylococcus aureus; identical to SEQ ID NO: 38262
  subsp. aureus VCU006

SEQ ID NO: 40828 - protein, 691 aa, Staphylococcus aureus; identical to SEQ ID NO: 38263
  subsp. aureus VCU006

SEQ ID NO: 40829 - protein, 203 aa, Staphylococcus aureus; identical to SEQ ID NO: 38264
  subsp. aureus VCU006

SEQ ID NO: 40830 - protein, 226 aa, Staphylococcus aureus
  subsp. aureus VCU006
MKFKAIAKASLALGMLATGVITSNVQSVQAKTEVKQQSEADLKLYYSGPSFEHKKVTGFKYTDEKGSFFEFIDRGQFNKVSLVGPDKDKLNDGDNSGLDVFVVREGYGRQADNHSIGGVTKTNRQSYFDQINTPILEIKNDSEDLYKGYHLIFKEDISLKELDYRLRERAIKQHGLYSNGLKQGQITITMNDGTTHTIDLSQKLEKERMGESIDGRQIQKILVEIK

SEQ ID NO: 40831 - protein, 231 aa, Staphylococcus aureus; identical to SEQ ID NO: 38266
  subsp. aureus VCU006

SEQ ID NO: 40832 - protein, 356 aa, Staphylococcus aureus; identical to SEQ ID NO: 30793
  subsp. aureus VCU006

SEQ ID NO: 40833 - protein, 281 aa, Staphylococcus aureus; identical to SEQ ID NO: 38268
  subsp. aureus VCU006

SEQ ID NO: 40834 - protein, 234 aa, Staphylococcus aureus; identical to SEQ ID NO: 33390
  subsp. aureus VCU006

SEQ ID NO: 40835 - protein, 231 aa, Staphylococcus aureus; identical to SEQ ID NO: 38270
  subsp. aureus VCU006

SEQ ID NO: 40836 - protein, 231 aa, Staphylococcus aureus; identical to SEQ ID NO: 35425
  subsp. aureus VCU006

SEQ ID NO: 40837 - protein, 331 aa, Staphylococcus aureus; identical to SEQ ID NO: 34042
  subsp. aureus VCU006

SEQ ID NO: 40838 - protein, 807 aa, Staphylococcus aureus; identical to SEQ ID NO: 38295
  subsp. aureus VCU006

SEQ ID NO: 40839 - protein, 327 aa, Staphylococcus aureus; identical to SEQ ID NO: 30616
  subsp. aureus VCU006

SEQ ID NO: 40840 - protein, 311 aa, Staphylococcus aureus; identical to SEQ ID NO: 30617
  subsp. aureus VCU006

SEQ ID NO: 40841 - protein, 96 aa, Staphylococcus aureus; identical to SEQ ID NO: 30813
  subsp. aureus VCU006

SEQ ID NO: 40842 - protein, 1406 aa, Staphylococcus aureus
  subsp. aureus VCU006
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSTVNQATPTSVQSSTPSAQNNNHTDGNTTATETVLNANNNDVVSNNTTLNVPNKTNENGSGGHLTLKEIQEDVRHSSDKPELVAIAEPASNRPKKRSRRAAPADPNATPADPAAAAAGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRILGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVYVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSPAESHTVSTNPYTIDIIMNKDALQAEVDRRIQQADYTFASLDIFNDLKKRAQTILAENRNNVPLNKRVSQADIDTLTNQMQHTLIRSVDAENAVNQKADQMEDLVNQNDELTDEEKQAAIQVIEEHKGNIIGDIGDQTTDDGVTRIKDQGIQTLSGDTATPVVKPNAKKAIRDKATKQREIINATPDATEDEIQDAINQLATDETDAIDNVTNATTNADVETAKNNGINTIGAVVPQVTHKKAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPKAIADIEKAVKEKQQQIDNSLDSTDNEKEVASQALAKEKKKHLQLLTKLKRIVR

SEQ ID NO: 40843 - protein, 62 aa, Staphylococcus aureus
  subsp. aureus VCU006
MYEQGGDIVKGYVKYHNDDEQNIEYNFYNLNGEYGYEILKMYADNKTINSDKLHLDIYLFKS

SEQ ID NO: 40844 - protein, 158 aa, Staphylococcus aureus
  subsp. aureus VCU006
MLEEILTNSASAIEYSDLHHKSKFDSKRLSNAKMSFINPTQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQAEIELTAVKTKRKLLPFKN

SEQ ID NO: 40845 - protein, 291 aa, Staphylococcus aureus; identical to SEQ ID NO: 30390
  subsp. aureus VCU006

SEQ ID NO: 40846 - protein, 895 aa, Staphylococcus aureus; identical to SEQ ID NO: 38294
  subsp. aureus VCU006

SEQ ID NO: 40847 - protein, 273 aa, Staphylococcus aureus
  subsp. aureus VCU006
MRYWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 40848 - protein, 338 aa, Staphylococcus aureus; identical to SEQ ID NO: 30627
  subsp. aureus VCU006

SEQ ID NO: 40849 - protein, 351 aa, Staphylococcus aureus; identical to SEQ ID NO: 30628
  subsp. aureus VCU006

SEQ ID NO: 40850 - protein, 644 aa, Staphylococcus aureus; identical to SEQ ID NO: 34015
  subsp. aureus VCU006

SEQ ID NO: 40851 - protein, 350 aa, Staphylococcus aureus; identical to SEQ ID NO: 38282
  subsp. aureus VCU006

SEQ ID NO: 40852 - protein, 2296 aa, Staphylococcus aureus
  subsp. aureus VCU006
MNYRDKIQKFSIRKYTVGTFSTVIATLVFLGFNTSQAHAAETNQPASVVKQKQQSNNEQTENRESQVQNSQNSQNGQSLSATHENEQPNISQANLVDQKVAQSSTTNDEQPASQNVNTKKDSATAATTQPDKEQSKHKQNESQSANKNGNDNRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPHRSHDFKIRNRSGQVIYDWPTVHIYSLEDLSRASDYFSEAGATPATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYSNNANTNAFRPGGAQQLNEYQLSQLFTDQKLQEAARTRNPIRLMIGFDYPDAYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRPNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIQPKDYVVFIPPVGKQIRAVVYYNKVVASNMSNAVTILPDDIPPTINNPVGINAKYYRGDEVSFTMGVSDRHSGLKSTTITTLPSGWTSNLTKSDNKNGSLAITGRVSMNQAFNSDITFKVSATDNVNNTTNDSQSKHVSIHVGKISEDAHPIVLGNTEKVVVVNPTAVSNDEKQSIITAFMNKNQNIRGYLASTDPVTVDNNGNVTLHYRDGSSTTLDATNVMTYEPVVKSEYQTANAAKTATVTIAKGQSFNIGDIKQYFTLSNGQAIPSGTFTNITSDRTIPTAQEVSQMNAGTQLYHITATNAYHKDSEDFYISLKIIDVKQPEGDQRVYRTSTYDLTTDEISKVKQAFINANRDVITLAEGDISVTNTPNGANVSTITVNINKGRLTKSFASNLANMNFLRWVNFAQDYTVSWTNAKIANRPTDGGLSWSDDHKSLIYRYDATLGTQITTNDILTMLKATTTVPGLRNNITGNEKSQAEAGGRPNFRTTGYSQSNATTDGQRQFTLNGQVIQVLDIINPSNGYGGQPVTNSNTRANHSNSTVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPNTSQITGTVDNNHQHVSATAPNVTSATNKTINLLATDTSGNTATTSFNVTVKPLRDKYRVGTSSTAANPVRIANISNNATVSQADQTTIINSLTFTETVPNRSYARASANEITSKTVSNVSRTGNNANVTVTVTYQDGTTSTVTVPVKHVIPEIVAHSHYTVQGQDFPAGNGSSASDYFKLSNGSDIPDATITWVSGQAPNKDNTRIGEDITVTAHILIDGETTPITKTATYKVVRTVPKHVFETARGVLYPGVSDMYDAKQYVKPVNNSWSTNAQHMNFQFVGTYGPNKDVVGISTRLIRVTYDNRQTEDLTILSKVKPDPPRIDANSVTYKAGLTNQEIKVNNVLNNSSVKLFKADNTPLNVTNITHGSGFSSVVTVSDALPNGGIKAKSSISMNNVTYTTQDEHGQVVTVTRNESVDSNDSATVTVTPQLQATTEGAVFIKGGDGFDFGHVERFIQNPPHGATVAWHDSPDTWKNTVGNTHKTAVVTLPNGQGTRNVEVPVKVYPVANAKAPSRDVKGQNLTNGTDAINYITFDPNTNTNGITAAWANRQQPNNQQAGVQHLNVDVTYPGISAAKRVPVTLNVYQFEFPQTTYTTTVGGTLASGTQASGYAQMQNATGLPTDGFTYKWNRDTTGTNDANWSAMNKPNVAKVVNAKYDVIYNGHTFATSLPAKFVVKDVQPAKPTVTETAAGAITIAPGANQTVNTHAGNVTTYADKLVIKRNGNVVTTFTRRNNTSPWVKEASAATVAGIAGTNNGITVAAGTFNPC

SEQ ID NO: 40853 - protein, 105 aa, Staphylococcus aureus; identical to SEQ ID NO: 33600
  subsp. aureus VCU006

SEQ ID NO: 40854 - protein, 165 aa, Staphylococcus aureus; identical to SEQ ID NO: 30418
  subsp. aureus VCU006

SEQ ID NO: 40855 - protein, 319 aa, Staphylococcus aureus
  subsp. aureus VCU006
MKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAAENFLDPNKASSLLSSGFSPDFATVITMDRKASKQQTNIDVICERVRDDYQLHWTSTNWKGTNTKDKWTDRSSERYKIDWEKEEMTN

SEQ ID NO: 40856 - protein, 238 aa, Staphylococcus aureus; identical to SEQ ID NO: 30740
  subsp. aureus VCU006

SEQ ID NO: 40857 - protein, 241 aa, Staphylococcus aureus; identical to SEQ ID NO: 38287
  subsp. aureus VCU006

SEQ ID NO: 40858 - protein, 250 aa, Staphylococcus aureus; identical to SEQ ID NO: 38288
  subsp. aureus VCU006

SEQ ID NO: 40859 - protein, 372 aa, Staphylococcus aureus; identical to SEQ ID NO: 30609
  subsp. aureus VCU006

SEQ ID NO: 40860 - protein, 434 aa, Staphylococcus aureus [sequence omitted]

SEQ ID NO: 40861 - protein, 921 aa, Staphylococcus aureus
  subsp. aureus VCU006
MASVLVGTLIGFGLLSSKEADASENSVTQSDSASNESKSNDSSSVSGAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQNTDASNKDVVNQAVNTSAPRKRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSGSDSNSDSGSDSASDSDSASDSDSASDSDSASDSDSASDSDSASDSDSASDSDSASDSDSASDSDSASDSDSASDSDSDSDSDSDSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDNDSDSDSDSESDSDSDSDSDSDSASDSDSGSDSDSDSDSDSDSDSDSDSESDSDSDSDSDSDSDSDSDSDSDSDLDSDSDSDSGSDSESDSDSDSESDSNSDSESGSNNNVVPPNSPKNGTNASNKNEAKDSKEPLPDTGSEDEANTSLIWGLLASLGSLLLFRRKKENKDKK

SEQ ID NO: 40862 - protein, 428 aa, Staphylococcus aureus
  subsp. aureus VCU006
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQSNPEDLKVSEVTRFNNKSIGKNELTGALQLKNKVSFKNDFEFNIRVANNHQSVTTGADGWGFLFSKGDGNEYLQKGGILGPKGMENSAGFKIDTGYNFKDPMDKEEKQAGQGFKGYGTFVKTGADGTTAKVGTNIPTRGKADNSFQYADNSIDTTDGKFHGQLLNNLKLAYNEKSGIMRAEYAGKIWEANISDLGLDKSEAYNFLITSSQRQGTSQGVYANGWMRTDLNNSTFKLTPNLVNKTET

SEQ ID NO: 40863 - protein, 939 aa, Staphylococcus aureus; identical to SEQ ID NO: 38255
  subsp. aureus VCU006

SEQ ID NO: 40864 - protein, 985 aa, Staphylococcus aureus; identical to SEQ ID NO: 38256
  subsp. aureus VCU006

SEQ ID NO: 40865 - protein, 233 aa, Staphylococcus aureus; identical to SEQ ID NO: 30428
  subsp. aureus VCU006

SEQ ID NO: 40866 - protein, 913 aa, Staphylococcus aureus
  subsp. aureus VCU006
MKKRIDYLSNKQNKYSIRRFTVGTTSVIVGATILFGIGNHQAQASEQSNDTTQSSKNNASADSEKNNMIETPQLNTTANDTSDISANTNSANVDSTAKPMSTQTSNTTTTEPASTNETPQLTAIKDQATAAKMQDQTVPQEANSQVDNKTTNDANSIATNSELKNPQTLDLPQSSPQTISNAQGTSKPSVRTRAVRSLAVAEPVVNAADAKGTNVNDKVTAKDFQLEKTTFDPNQSGNTFMAANFTVTGQVKSGDYFTAKLPDSVTGNGDVDYSNSNNTMPIADIVNDKNEVVAKATYDILTKTYTFVFTDYVNDKQNINGKFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKDKITYKYQNVASINFGDINKTYVVLVEGHYDKTGKNLKTQVIQENVDPATGKDYSIFGWNNENVVRYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSDSESDSDSDSDSESDSDSDSDSDSDSDSDSDSDSDSDSDSDSDSDSDSESDSDSDSDSDSDSDSDSDSDSDSDSDSDSDSDSDSDSDSDSDSESDSDSDSDSDSDSDSDSDSDSDSDSDSDSDSDSDSESDSDSDSDSDSDSDSDSDSDSYSDSDSDSDSRVTPPNNEQKAPSNPKGEVNHSNKVSKQHKTDALPETGDKSENTNATLFGAMMALLGSLLLFRKRKQDHKEKA

SEQ ID NO: 40867 - protein, 2275 aa, Staphylococcus aureus
  subsp. aureus VCU006
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSENVTSTTNSTSNQQEKLTSTSESTSSKNTTSSSDTKSVASTSSTEQPINISTNQSTASNNTSQSTTPSSANLNKTSTTSTSTAPVKLRTFSRLAMSTFASAATTTALIANTITVNKDNLKQYMTTSGNATYDQSTGVVTLTQDTTSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSNSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSAMSAKGYNYTSVDSSYASTYNDTNKTVKMTNAGQSVTYYFTDVKAPTVTVGNQTTEVGKTMNPVVLTTTDNGTGTVTNTVTGLPSGLSYDSATNSIIGTPTKIGQSTVTVVSTDQANNKSTTAFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVDSQSVSSSMSGSVSKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSISGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSNSESTSTSKSESVSTSLSTSTSTSLSDSTSLSTSISDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSMSRSTSQSGSVSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSLSDSSSTSTSTSLSDSMSQSQSTSTSASGSLSTSISTSMSMSASTSSSQSTSVSTSLSTSDSISDSTSISISCSQSTVESESTSDSTSISDSESLSTSDSDSTSTSTSDSTSGSTSTSISESLSTSGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 40868 - protein, 681 aa, Staphylococcus aureus; identical to SEQ ID NO: 38260
  subsp. aureus VCU006

SEQ ID NO: 40869 - protein, 598 aa, Staphylococcus aureus
  subsp. aureus VRS1
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDS

SEQ ID NO: 40870 - protein, 2271 aa, Staphylococcus aureus; identical to SEQ ID NO: 30597
  subsp. aureus VRS1

SEQ ID NO: 40871 - protein, 681 aa, Staphylococcus aureus; identical to SEQ ID NO: 30598
  subsp. aureus VRS1

SEQ ID NO: 40872 - protein, 233 aa, Staphylococcus aureus; identical to SEQ ID NO: 30591
  subsp. aureus VRS1

SEQ ID NO: 40873 - protein, 211 aa, Staphylococcus aureus; identical to SEQ ID NO: 30592
  subsp. aureus VRS1

SEQ ID NO: 40874 - protein, 95 aa, Staphylococcus aureus
  subsp. aureus VRS1
RFRSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 40875 - protein, 815 aa, Staphylococcus aureus
  subsp. aureus VRS1
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQI

SEQ ID NO: 40876 - protein, 783 aa, Staphylococcus aureus
  subsp. aureus VRS1
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNVGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDNKQR

SEQ ID NO: 40877 - protein, 74 aa, Staphylococcus aureus
  subsp. aureus VRS1
KPSKPVEQGKVVTPVIEINEKVKAVAPTKKAQSKKSELPETGGEESTNKGMLFGGLFSILGLALLRRNKKNNKA

SEQ ID NO: 40878 - protein, 859 aa, Staphylococcus aureus
  subsp. aureus VRS1
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKAPSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 40879 - protein, 53 aa, Staphylococcus aureus
  subsp. aureus VRS1
QWHQPKQKTKILRKSELPETGGEESTNKGMLFGGLFSILGLVLLRRNKKNNKA

SEQ ID NO: 40880 - protein, 321 aa, Staphylococcus aureus; identical to SEQ ID NO: 30959
  subsp. aureus VRS1

SEQ ID NO: 40881 - protein, 72 aa, Staphylococcus aureus
  subsp. aureus VRS1
MLKNKILATTLSVSLLAPLANPLLENAKAANDTEDIGKGSDIEIIKRTEDKTSNKWGVTQNIQFDFVKDKKI

SEQ ID NO: 40882 - protein, 235 aa, Staphylococcus aureus
  subsp. aureus VRS1
MQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 40883 - protein, 325 aa, Staphylococcus aureus; identical to SEQ ID NO: 30407
  subsp. aureus VRS1

SEQ ID NO: 40884 - protein, 809 aa, Staphylococcus aureus; identical to SEQ ID NO: 30632
  subsp. aureus VRS1

SEQ ID NO: 40885 - protein, 141 aa, Staphylococcus aureus; identical to SEQ ID NO: 30633
  subsp. aureus VRS1

SEQ ID NO: 40886 - protein, 2481 aa, Staphylococcus aureus
  subsp. aureus VRS1
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGACMAFLIRRFTKKDQQTEE

SEQ ID NO: 40887 - protein, 231 aa, Staphylococcus aureus; identical to SEQ ID NO: 30630
  subsp. aureus VRS1

SEQ ID NO: 40888 - protein, 44 aa, Staphylococcus aureus; identical to SEQ ID NO: 30513
  subsp. aureus VRS1

SEQ ID NO: 40889 - protein, 274 aa, Staphylococcus aureus; identical to SEQ ID NO: 30815
  subsp. aureus VRS1

SEQ ID NO: 40890 - protein, 338 aa, Staphylococcus aureus; identical to SEQ ID NO: 30627
  subsp. aureus VRS1

SEQ ID NO: 40891 - protein, 351 aa, Staphylococcus aureus; identical to SEQ ID NO: 30628
  subsp. aureus VRS1

SEQ ID NO: 40892 - protein, 96 aa, Staphylococcus aureus; identical to SEQ ID NO: 30813
  subsp. aureus VRS1

SEQ ID NO: 40893 - protein, 327 aa, Staphylococcus aureus; identical to SEQ ID NO: 30616
  subsp. aureus VRS1

SEQ ID NO: 40894 - protein, 311 aa, Staphylococcus aureus; identical to SEQ ID NO: 30617
  subsp. aureus VRS1

SEQ ID NO: 40895 - protein, 258 aa, Staphylococcus aureus; identical to SEQ ID NO: 30410
  subsp. aureus VRS1

SEQ ID NO: 40896 - protein, 251 aa, Staphylococcus aureus; identical to SEQ ID NO: 30946
  subsp. aureus VRS1

SEQ ID NO: 40897 - protein, 131 aa, Staphylococcus aureus
  subsp. aureus VRS1
MYGCVTEHDGNQIDKNNSTDNSHNILIKVYENERNSLSFDIPTNKKNITAQEIDYKVRNYLLKHKNLYEFNSSPYETGYIKFIEGSGHSFWYDLMPESGKKFYPTKYLLIYNDNKTVESKSINVEVHLTKK

SEQ ID NO: 40898 - protein, 242 aa, Staphylococcus aureus; identical to SEQ ID NO: 30399
  subsp. aureus VRS1

SEQ ID NO: 40899 - protein, 239 aa, Staphylococcus aureus; identical to SEQ ID NO: 30622
  subsp. aureus VRS1

SEQ ID NO: 40900 - protein, 254 aa, Staphylococcus aureus; identical to SEQ ID NO: 30809
  subsp. aureus VRS1

SEQ ID NO: 40901 - protein, 331 aa, Staphylococcus aureus; identical to SEQ ID NO: 30615
  subsp. aureus VRS1

SEQ ID NO: 40902 - protein, 2186 aa, Staphylococcus aureus; identical to SEQ ID NO: 30789
  subsp. aureus VRS1

SEQ ID NO: 40903 - protein, 891 aa, Staphylococcus aureus; identical to SEQ ID NO: 30788
  subsp. aureus VRS1

SEQ ID NO: 40904 - protein, 104 aa, Staphylococcus aureus; identical to SEQ ID NO: 39434
  subsp. aureus VRS1

SEQ ID NO: 40905 - protein, 291 aa, Staphylococcus aureus; identical to SEQ ID NO: 33009
  subsp. aureus VRS1

SEQ ID NO: 40906 - protein, 62 aa, Staphylococcus aureus; identical to SEQ ID NO: 30610
  subsp. aureus VRS1

SEQ ID NO: 40907 - protein, 157 aa, Staphylococcus aureus; identical to SEQ ID NO: 30611
  subsp. aureus VRS1

SEQ ID NO: 40908 - protein, 372 aa, Staphylococcus aureus
  subsp. aureus VRS1
MNKQQSKVRYSIRKVSIGILSISIGMFLALGMSNKAYADEIDKSKDFTRGYEQNVFAKSELNANKNTTKDKIKNEGAVKTSDTSLKLDSKSAISNGNEINQDIKISNTPKNSSQGNNLVINNNEPTKEIKIANLEAQNSNQKKTSKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 40909 - protein, 319 aa, Staphylococcus aureus; identical to SEQ ID NO: 30605
  subsp. aureus VRS1

SEQ ID NO: 40910 - protein, 238 aa, Staphylococcus aureus; identical to SEQ ID NO: 30606
  subsp. aureus VRS1

SEQ ID NO: 40911 - protein, 241 aa, Staphylococcus aureus; identical to SEQ ID NO: 30607
  subsp. aureus VRS1

SEQ ID NO: 40912 - protein, 241 aa, Staphylococcus aureus; identical to SEQ ID NO: 30608
  subsp. aureus VRS1

SEQ ID NO: 40913 - protein, 645 aa, Staphylococcus aureus
  subsp. aureus VRS1
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKAVKPAAKATNNTYPILNQELREAIKNPAIKDKDHSAPNSRPSDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 40914 - protein, 350 aa, Staphylococcus aureus; identical to SEQ ID NO: 30602
  subsp. aureus VRS1

SEQ ID NO: 40915 - protein, 109 aa, Staphylococcus aureus; identical to SEQ ID NO: 30603
  subsp. aureus VRS1

SEQ ID NO: 40916 - protein, 165 aa, Staphylococcus aureus; identical to SEQ ID NO: 30418
  subsp. aureus VRS1

SEQ ID NO: 40917 - protein, 434 aa, Staphylococcus aureus [sequence omitted]

SEQ ID NO: 40918 - protein, 602 aa, Staphylococcus aureus
  subsp. aureus VRS1
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASD

SEQ ID NO: 40919 - protein, 42 aa, Staphylococcus aureus
  subsp. aureus VRS1
KAKALPETGNENSGSNNATLFGGLFAALGSLLLFGRRKKQNK

SEQ ID NO: 40920 - protein, 916 aa, Staphylococcus aureus
  subsp. aureus VRS1
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDV

SEQ ID NO: 40921 - protein, 249 aa, Staphylococcus aureus
  subsp. aureus VRS1
ADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 40922 - protein, 1075 aa, Staphylococcus aureus
  subsp. aureus VRS1
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKV

SEQ ID NO: 40923 - protein, 742 aa, Staphylococcus aureus
  subsp. aureus VRS1
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDS

SEQ ID NO: 40924 - protein, 227 aa, Staphylococcus aureus; identical to SEQ ID NO: 30586
  subsp. aureus VRS1

SEQ ID NO: 40925 - protein, 691 aa, Staphylococcus aureus; identical to SEQ ID NO: 30511
  subsp. aureus VRS1

SEQ ID NO: 40926 - protein, 203 aa, Staphylococcus aureus; identical to SEQ ID NO: 30576
  subsp. aureus VRS1

SEQ ID NO: 40927 - protein, 226 aa, Staphylococcus aureus; identical to SEQ ID NO: 30577
  subsp. aureus VRS1

SEQ ID NO: 40928 - protein, 231 aa, Staphylococcus aureus; identical to SEQ ID NO: 30578
  subsp. aureus VRS1

SEQ ID NO: 40929 - protein, 356 aa, Staphylococcus aureus
  subsp. aureus VRS1
MNMKTIAKTSLALGLLTTGAITVTTQSVKAEKIQSTKVDKVPTLKAERLAMINITAGANSATTQAANTRQERTPKLEKAPNTNEEKTSASKIEKISQPKQEEQKSLNISATPAPKQEQSQTTTESTTPKTKVTTPPSTNTPQPMQSTKSDTPQSPTIKQAQTDMTPKYEDLRAYYTKPSFEFEKQFGFLLKPWTTVRFMNVIPNRFIYKIALVGKDEKKYKDGPYDNIDVFIVLEDNKYQLKKYSVGGITKTNSKKVDHKAELSVTKKDNQGMISRDVSEYMITKEEISLKELDFKLRKQLIEKHNLYGNMGSGTIVIKMKNGGKYTFELHKKLQEHRMADVIEGTSIDKIEVNIK

SEQ ID NO: 40930 - protein, 292 aa, Staphylococcus aureus; identical to SEQ ID NO: 30580
  subsp. aureus VRS1

SEQ ID NO: 40931 - protein, 234 aa, Staphylococcus aureus; identical to SEQ ID NO: 30581
  subsp. aureus VRS1

SEQ ID NO: 40932 - protein, 231 aa, Staphylococcus aureus; identical to SEQ ID NO: 30582
  subsp. aureus VRS1

SEQ ID NO: 40933 - protein, 232 aa, Staphylococcus aureus; identical to SEQ ID NO: 30583
  subsp. aureus VRS1

SEQ ID NO: 40934 - protein, 232 aa, Staphylococcus aureus; identical to SEQ ID NO: 30584
  subsp. aureus VRS1

SEQ ID NO: 40935 - protein, 227 aa, Staphylococcus aureus; identical to SEQ ID NO: 30585
  subsp. aureus VRS1

SEQ ID NO: 40936 - protein, 179 aa, Staphylococcus aureus
  subsp. aureus VRS1
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFY

SEQ ID NO: 40937 - protein, 241 aa, Staphylococcus aureus; identical to SEQ ID NO: 30571
  subsp. aureus VRS1

SEQ ID NO: 40938 - protein, 61 aa, Staphylococcus aureus; identical to SEQ ID NO: 34190
  subsp. aureus VRS1

SEQ ID NO: 40939 - protein, 216 aa, Staphylococcus aureus
  subsp. aureus VRS10
MKKIALLTLFSTALLVSAPLVSFADEATGSSGVNVLADDVVDPVEPTDPTTPVDPVDPVDPVDPVDPVDPTEPTEPTEPTEPTEPTEPTEPTEPTEPTEPSKPTEPTEPSKPTEPTEPSKPVDTNPIENPVNTDTGVVIVAVEDSKPIIQLADGTTKKVEAKEIGANVQKDGTVTVKGTDGKMKVLPKTGETTNVALSVLGSFMVLVSGLIFKKRI

SEQ ID NO: 40940 - protein, 2269 aa, Staphylococcus aureus
  subsp. aureus VRS10
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSISDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 40941 - protein, 681 aa, Staphylococcus aureus; identical to SEQ ID NO: 30598
  subsp. aureus VRS10

SEQ ID NO: 40942 - protein, 745 aa, Staphylococcus aureus
  subsp. aureus VRS10
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPDPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDSDSDSDSD

SEQ ID NO: 40943 - protein, 211 aa, Staphylococcus aureus; identical to SEQ ID NO: 30592
  subsp. aureus VRS10

SEQ ID NO: 40944 - protein, 149 aa, Staphylococcus aureus; identical to SEQ ID NO: 33681
  subsp. aureus VRS10

SEQ ID NO: 40945 - protein, 859 aa, Staphylococcus aureus
  subsp. aureus VRS10
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 40946 - protein, 961 aa, Staphylococcus aureus; identical to SEQ ID NO: 30589
  subsp. aureus VRS10

SEQ ID NO: 40947 - protein, 1038 aa, Staphylococcus aureus; identical to SEQ ID NO: 30590
  subsp. aureus VRS10

SEQ ID NO: 40948 - protein, 233 aa, Staphylococcus aureus; identical to SEQ ID NO: 30591
  subsp. aureus VRS10

SEQ ID NO: 40949 - protein, 321 aa, Staphylococcus aureus; identical to SEQ ID NO: 30959
  subsp. aureus VRS10

SEQ ID NO: 40950 - protein, 315 aa, Staphylococcus aureus; identical to SEQ ID NO: 30573
  subsp. aureus VRS10

SEQ ID NO: 40951 - protein, 325 aa, Staphylococcus aureus; identical to SEQ ID NO: 30407
  subsp. aureus VRS10

SEQ ID NO: 40952 - protein, 809 aa, Staphylococcus aureus; identical to SEQ ID NO: 30632
  subsp. aureus VRS10

SEQ ID NO: 40953 - protein, 141 aa, Staphylococcus aureus; identical to SEQ ID NO: 30633
  subsp. aureus VRS10

SEQ ID NO: 40954 - protein, 231 aa, Staphylococcus aureus; identical to SEQ ID NO: 30630
  subsp. aureus VRS10

SEQ ID NO: 40955 - protein, 2481 aa, Staphylococcus aureus; identical to SEQ ID NO: 30631
  subsp. aureus VRS10

SEQ ID NO: 40956 - protein, 274 aa, Staphylococcus aureus; identical to SEQ ID NO: 30815
  subsp. aureus VRS10

SEQ ID NO: 40957 - protein, 338 aa, Staphylococcus aureus
  subsp. aureus VRS10
MIKQLYKNITICSLAISTALTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVNDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHDVKFVKVLNDNEKK

SEQ ID NO: 40958 - protein, 351 aa, Staphylococcus aureus; identical to SEQ ID NO: 30628
  subsp. aureus VRS10

SEQ ID NO: 40959 - protein, 44 aa, Staphylococcus aureus; identical to SEQ ID NO: 30513
  subsp. aureus VRS10

SEQ ID NO: 40960 - protein, 96 aa, Staphylococcus aureus; identical to SEQ ID NO: 30813
  subsp. aureus VRS10

SEQ ID NO: 40961 - protein, 260 aa, Staphylococcus aureus; identical to SEQ ID NO: 30625
  subsp. aureus VRS10

SEQ ID NO: 40962 - protein, 331 aa, Staphylococcus aureus; identical to SEQ ID NO: 30615
  subsp. aureus VRS10

SEQ ID NO: 40963 - protein, 327 aa, Staphylococcus aureus; identical to SEQ ID NO: 30616
  subsp. aureus VRS10

SEQ ID NO: 40964 - protein, 311 aa, Staphylococcus aureus; identical to SEQ ID NO: 30617
  subsp. aureus VRS10

SEQ ID NO: 40965 - protein, 258 aa, Staphylococcus aureus; identical to SEQ ID NO: 30410
  subsp. aureus VRS10

SEQ ID NO: 40966 - protein, 251 aa, Staphylococcus aureus; identical to SEQ ID NO: 30946
  subsp. aureus VRS10

SEQ ID NO: 40967 - protein, 131 aa, Staphylococcus aureus; identical to SEQ ID NO: 30867
  subsp. aureus VRS10

SEQ ID NO: 40968 - protein, 242 aa, Staphylococcus aureus; identical to SEQ ID NO: 30399
  subsp. aureus VRS10

SEQ ID NO: 40969 - protein, 239 aa, Staphylococcus aureus; identical to SEQ ID NO: 30622
  subsp. aureus VRS10

SEQ ID NO: 40970 - protein, 254 aa, Staphylococcus aureus; identical to SEQ ID NO: 30809
  subsp. aureus VRS10

SEQ ID NO: 40971 - protein, 891 aa, Staphylococcus aureus; identical to SEQ ID NO: 30788
  subsp. aureus VRS10

SEQ ID NO: 40972 - protein, 2186 aa, Staphylococcus aureus; identical to SEQ ID NO: 30789
  subsp. aureus VRS10

SEQ ID NO: 40973 - protein, 319 aa, Staphylococcus aureus; identical to SEQ ID NO: 30605
  subsp. aureus VRS10

SEQ ID NO: 40974 - protein, 238 aa, Staphylococcus aureus; identical to SEQ ID NO: 30606
  subsp. aureus VRS10

SEQ ID NO: 40975 - protein, 241 aa, Staphylococcus aureus; identical to SEQ ID NO: 30607
  subsp. aureus VRS10

SEQ ID NO: 40976 - protein, 241 aa, Staphylococcus aureus; identical to SEQ ID NO: 30608
  subsp. aureus VRS10

SEQ ID NO: 40977 - protein, 372 aa, Staphylococcus aureus; identical to SEQ ID NO: 30609
  subsp. aureus VRS10

SEQ ID NO: 40978 - protein, 62 aa, Staphylococcus aureus; identical to SEQ ID NO: 30610
  subsp. aureus VRS10

SEQ ID NO: 40979 - protein, 157 aa, Staphylococcus aureus; identical to SEQ ID NO: 30611
  subsp. aureus VRS10

SEQ ID NO: 40980 - protein, 291 aa, Staphylococcus aureus; identical to SEQ ID NO: 33009
  subsp. aureus VRS10

SEQ ID NO: 40981 - protein, 645 aa, Staphylococcus aureus; identical to SEQ ID NO: 30601
  subsp. aureus VRS10

SEQ ID NO: 40982 - protein, 350 aa, Staphylococcus aureus; identical to SEQ ID NO: 30602
  subsp. aureus VRS10

SEQ ID NO: 40983 - protein, 109 aa, Staphylococcus aureus; identical to SEQ ID NO: 30603
  subsp. aureus VRS10

SEQ ID NO: 40984 - protein, 138 aa, Staphylococcus aureus
  subsp. aureus VRS10
MKNKLIAKSLLTIAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKHILSVHTEKHKRQST

SEQ ID NO: 40985 - protein, 434 aa, Staphylococcus aureus [sequence omitted]

SEQ ID NO: 40986 - protein, 905 aa, Staphylococcus aureus; identical to SEQ ID NO: 30600
  subsp. aureus VRS10

SEQ ID NO: 40987 - protein, 181 aa, Staphylococcus aureus
  subsp. aureus VRS10
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 40988 - protein, 140 aa, Staphylococcus aureus
  subsp. aureus VRS10
SDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 40989 - protein, 1337 aa, Staphylococcus aureus; identical to SEQ ID NO: 30811
  subsp. aureus VRS10

SEQ ID NO: 40990 - protein, 1003 aa, Staphylococcus aureus
  subsp. aureus VRS10
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSD

SEQ ID NO: 40991 - protein, 825 aa, Staphylococcus aureus
  subsp. aureus VRS10
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDND

SEQ ID NO: 40992 - protein, 691 aa, Staphylococcus aureus
  subsp. aureus VRS10
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGNNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFINVTNDEPATRRGIWQVKPIIQGWDHVDFIGVDFLDFKRKGAELANFYTGIINDLLRVEATESKGTQLKAS

SEQ ID NO: 40993 - protein, 203 aa, Staphylococcus aureus; identical to SEQ ID NO: 30576
  subsp. aureus VRS10

SEQ ID NO: 40994 - protein, 226 aa, Staphylococcus aureus; identical to SEQ ID NO: 30577
  subsp. aureus VRS10

SEQ ID NO: 40995 - protein, 231 aa, Staphylococcus aureus; identical to SEQ ID NO: 30578
  subsp. aureus VRS10

SEQ ID NO: 40996 - protein, 356 aa, Staphylococcus aureus; identical to SEQ ID NO: 30793
  subsp. aureus VRS10

SEQ ID NO: 40997 - protein, 292 aa, Staphylococcus aureus; identical to SEQ ID NO: 30580
  subsp. aureus VRS10

SEQ ID NO: 40998 - protein, 234 aa, Staphylococcus aureus; identical to SEQ ID NO: 30581
  subsp. aureus VRS10

SEQ ID NO: 40999 - protein, 231 aa, Staphylococcus aureus; identical to SEQ ID NO: 30582
  subsp. aureus VRS10

SEQ ID NO: 41000 - protein, 232 aa, Staphylococcus aureus; identical to SEQ ID NO: 30583
  subsp. aureus VRS10

SEQ ID NO: 41001 - protein, 232 aa, Staphylococcus aureus; identical to SEQ ID NO: 30584
  subsp. aureus VRS10

SEQ ID NO: 41002 - protein, 227 aa, Staphylococcus aureus; identical to SEQ ID NO: 30585
  subsp. aureus VRS10

SEQ ID NO: 41003 - protein, 227 aa, Staphylococcus aureus; identical to SEQ ID NO: 30586
  subsp. aureus VRS10

SEQ ID NO: 41004 - protein, 168 aa, Staphylococcus aureus
  subsp. aureus VRS10
MSKEILAEAKKLNDAQAPKEEDNKKPGKEDGNKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41005 - protein, 216 aa, Staphylococcus aureus
  subsp. aureus VRS10
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLLQKLKS

SEQ ID NO: 41006 - protein, 241 aa, Staphylococcus aureus; identical to SEQ ID NO: 30571
  subsp. aureus VRS10

SEQ ID NO: 41007 - protein, 168 aa, Staphylococcus aureus
  subsp. aureus VRS10
NLAKKTATSLVKKTTKNLVKKTATSLVKKTTTNLGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41008 - protein, 259 aa, Staphylococcus aureus; identical to SEQ ID NO: 30226
  subsp. aureus VRS10

SEQ ID NO: 41009 - protein, 268 aa, Staphylococcus aureus
  subsp. aureus VRS10
MKKTIFILIFSLTLTLLITPLVYSDSKNETIKEKNLHKKSELSSITLNNLRHIYFFNEKGISEKIMTEDQFLDYTLLFKSFFISYSQYNDLLVQFDSKETVNKFKGKQVDLYGSYYGFQCSGGKPNKTACMYGGVTLHENNQLYDTKKIPINLWIDSIRTVVPLDIVKTNKKKVTIQELDLQARYYLHKQYNLYNPSTFDGKIQKGLIVFHTSKEPLVSYDLFNVIGQYPDKLLKIYQDNKIIESENMHIDIYLYTSLIVLISLPLVL

SEQ ID NO: 41010 - protein, 179 aa, Staphylococcus aureus; identical to SEQ ID NO: 30225
  subsp. aureus VRS10

SEQ ID NO: 41011 - protein, 71 aa, Staphylococcus aureus
  subsp. aureus VRS10
MQKDLKLYNNDTLGGKIQRGKIEFDSSDGSKVSYDLFDVKGDFPEKQLRIYSDNKTLSTEHLHIDIYLYEK

SEQ ID NO: 41012 - protein, 683 aa, Staphylococcus aureus
  subsp. aureus VRS11a
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSD

SEQ ID NO: 41013 - protein, 2271 aa, Staphylococcus aureus; identical to SEQ ID NO: 30597
  subsp. aureus VRS11a

SEQ ID NO: 41014 - protein, 681 aa, Staphylococcus aureus; identical to SEQ ID NO: 30598
  subsp. aureus VRS11a

SEQ ID NO: 41015 - protein, 321 aa, Staphylococcus aureus; identical to SEQ ID NO: 30959
  subsp. aureus VRS11a

SEQ ID NO: 41016 - protein, 315 aa, Staphylococcus aureus; identical to SEQ ID NO: 30573
  subsp. aureus VRS11a

SEQ ID NO: 41017 - protein, 325 aa, Staphylococcus aureus; identical to SEQ ID NO: 30407
  subsp. aureus VRS11a

SEQ ID NO: 41018 - protein, 188 aa, Staphylococcus aureus
  subsp. aureus VRS11a
MIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 41019 - protein, 535 aa, Staphylococcus aureus
  subsp. aureus VRS11a
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEKFQVNQELRIQKQEM

SEQ ID NO: 41020 - protein, 961 aa, Staphylococcus aureus; identical to SEQ ID NO: 30589
  subsp. aureus VRS11a

SEQ ID NO: 41021 - protein, 1038 aa, Staphylococcus aureus; identical to SEQ ID NO: 30590
  subsp. aureus VRS11a

SEQ ID NO: 41022 - protein, 233 aa, Staphylococcus aureus; identical to SEQ ID NO: 30591
  subsp. aureus VRS11a

SEQ ID NO: 41023 - protein, 211 aa, Staphylococcus aureus; identical to SEQ ID NO: 30592
  subsp. aureus VRS11a

SEQ ID NO: 41024 - protein, 132 aa, Staphylococcus aureus
  subsp. aureus VRS11a
ATQTQTSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 41025 - protein, 809 aa, Staphylococcus aureus; identical to SEQ ID NO: 30632
  subsp. aureus VRS11a

SEQ ID NO: 41026 - protein, 141 aa, Staphylococcus aureus; identical to SEQ ID NO: 30633
  subsp. aureus VRS11a

SEQ ID NO: 41027 - protein, 2481 aa, Staphylococcus aureus
  subsp. aureus VRS11a
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQTKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 41028 - protein, 231 aa, Staphylococcus aureus; identical to SEQ ID NO: 30630
  subsp. aureus VRS11a

SEQ ID NO: 41029 - protein, 96 aa, Staphylococcus aureus; identical to SEQ ID NO: 30813
  subsp. aureus VRS11a

SEQ ID NO: 41030 - protein, 274 aa, Staphylococcus aureus; identical to SEQ ID NO: 30815
  subsp. aureus VRS11a

SEQ ID NO: 41031 - protein, 338 aa, Staphylococcus aureus; identical to SEQ ID NO: 30627
  subsp. aureus VRS11a

SEQ ID NO: 41032 - protein, 351 aa, Staphylococcus aureus; identical to SEQ ID NO: 30628
  subsp. aureus VRS11a

SEQ ID NO: 41033 - protein, 44 aa, Staphylococcus aureus; identical to SEQ ID NO: 30513
  subsp. aureus VRS11a

SEQ ID NO: 41034 - protein, 327 aa, Staphylococcus aureus; identical to SEQ ID NO: 30616
  subsp. aureus VRS11a

SEQ ID NO: 41035 - protein, 311 aa, Staphylococcus aureus; identical to SEQ ID NO: 30617
  subsp. aureus VRS11a

SEQ ID NO: 41036 - protein, 258 aa, Staphylococcus aureus; identical to SEQ ID NO: 30410
  subsp. aureus VRS11a

SEQ ID NO: 41037 - protein, 251 aa, Staphylococcus aureus; identical to SEQ ID NO: 30946
  subsp. aureus VRS11a

SEQ ID NO: 41038 - protein, 131 aa, Staphylococcus aureus; identical to SEQ ID NO: 30867
  subsp. aureus VRS11a

SEQ ID NO: 41039 - protein, 242 aa, Staphylococcus aureus; identical to SEQ ID NO: 30399
  subsp. aureus VRS11a

SEQ ID NO: 41040 - protein, 239 aa, Staphylococcus aureus; identical to SEQ ID NO: 30622
  subsp. aureus VRS11a

SEQ ID NO: 41041 - protein, 254 aa, Staphylococcus aureus; identical to SEQ ID NO: 30809
  subsp. aureus VRS11a

SEQ ID NO: 41042 - protein, 891 aa, Staphylococcus aureus; identical to SEQ ID NO: 30788
  subsp. aureus VRS11a

SEQ ID NO: 41043 - protein, 2186 aa, Staphylococcus aureus; identical to SEQ ID NO: 30789
  subsp. aureus VRS11a

SEQ ID NO: 41044 - protein, 331 aa, Staphylococcus aureus; identical to SEQ ID NO: 30615
  subsp. aureus VRS11a

SEQ ID NO: 41045 - protein, 62 aa, Staphylococcus aureus; identical to SEQ ID NO: 30610
  subsp. aureus VRS11a

SEQ ID NO: 41046 - protein, 157 aa, Staphylococcus aureus; identical to SEQ ID NO: 30611
  subsp. aureus VRS11a

SEQ ID NO: 41047 - protein, 291 aa, Staphylococcus aureus; identical to SEQ ID NO: 30390
  subsp. aureus VRS11a

SEQ ID NO: 41048 - protein, 319 aa, Staphylococcus aureus; identical to SEQ ID NO: 30605
  subsp. aureus VRS11a

SEQ ID NO: 41049 - protein, 238 aa, Staphylococcus aureus; identical to SEQ ID NO: 30606
  subsp. aureus VRS11a

SEQ ID NO: 41050 - protein, 241 aa, Staphylococcus aureus; identical to SEQ ID NO: 30607
  subsp. aureus VRS11a

SEQ ID NO: 41051 - protein, 241 aa, Staphylococcus aureus; identical to SEQ ID NO: 30608
  subsp. aureus VRS11a

SEQ ID NO: 41052 - protein, 372 aa, Staphylococcus aureus; identical to SEQ ID NO: 30609
  subsp. aureus VRS11a

SEQ ID NO: 41053 - protein, 645 aa, Staphylococcus aureus; identical to SEQ ID NO: 30601
  subsp. aureus VRS11a

SEQ ID NO: 41054 - protein, 350 aa, Staphylococcus aureus; identical to SEQ ID NO: 30602
  subsp. aureus VRS11a

SEQ ID NO: 41055 - protein, 109 aa, Staphylococcus aureus; identical to SEQ ID NO: 30603
  subsp. aureus VRS11a

SEQ ID NO: 41056 - protein, 165 aa, Staphylococcus aureus; identical to SEQ ID NO: 30418
  subsp. aureus VRS11a

SEQ ID NO: 41057 - protein, 434 aa, Staphylococcus aureus [sequence omitted]

SEQ ID NO: 41058 - protein, 851 aa, Staphylococcus aureus
  subsp. aureus VRS11a
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41059 - protein, 130 aa, Staphylococcus aureus
  subsp. aureus VRS11a
SDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 41060 - protein, 51 aa, Staphylococcus aureus; identical to SEQ ID NO: 32234
  subsp. aureus VRS11a

SEQ ID NO: 41061 - protein, 1008 aa, Staphylococcus aureus
  subsp. aureus VRS11a
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDS

SEQ ID NO: 41062 - protein, 113 aa, Staphylococcus aureus
  subsp. aureus VRS11a
DSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 41063 - protein, 1186 aa, Staphylococcus aureus
  subsp. aureus VRS11a
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDS

SEQ ID NO: 41064 - protein, 806 aa, Staphylococcus aureus
  subsp. aureus VRS11a
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKKLDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSESDSDSDSDSDSDSDSDSDSDSDSDSDSDSDSDSDSDSDS

SEQ ID NO: 41065 - protein, 227 aa, Staphylococcus aureus; identical to SEQ ID NO: 30586
  subsp. aureus VRS11a

SEQ ID NO: 41066 - protein, 691 aa, Staphylococcus aureus; identical to SEQ ID NO: 30511
  subsp. aureus VRS11a

SEQ ID NO: 41067 - protein, 203 aa, Staphylococcus aureus; identical to SEQ ID NO: 30576
  subsp. aureus VRS11a

SEQ ID NO: 41068 - protein, 226 aa, Staphylococcus aureus; identical to SEQ ID NO: 30577
  subsp. aureus VRS11a

SEQ ID NO: 41069 - protein, 231 aa, Staphylococcus aureus; identical to SEQ ID NO: 30578
  subsp. aureus VRS11a

SEQ ID NO: 41070 - protein, 356 aa, Staphylococcus aureus; identical to SEQ ID NO: 30579
  subsp. aureus VRS11a

SEQ ID NO: 41071 - protein, 292 aa, Staphylococcus aureus
  subsp. aureus VRS11a
MKITTIAKTSLALGLLTTGVITTTTQEANATTPSSTKVEAPQSTPPSTKVEAPQSKPNATTPPSTKVETPQQTPDATTPSSTKVETPQSPTTKQVPTEINPKFKDLRAYYTKPSLEFKNEIGIILKKWTTIRFMNIVPDYFIYKIALVGKDDKKYDEGVHRNVDVFVVLEEKNKYGVERYSVGGITKSNSKKVDHKAGVRITKEDNKGTISHDVSEFKITKEQISLKELDFKLRKQLIENHNLYGNVGSGKIVINMKNGGKYTFELHKKLQENRMADVIDGTNIDNIEVNIK

SEQ ID NO: 41072 - protein, 234 aa, Staphylococcus aureus; identical to SEQ ID NO: 30581
  subsp. aureus VRS11a

SEQ ID NO: 41073 - protein, 231 aa, Staphylococcus aureus; identical to SEQ ID NO: 30582
  subsp. aureus VRS11a

SEQ ID NO: 41074 - protein, 232 aa, Staphylococcus aureus; identical to SEQ ID NO: 30583
  subsp. aureus VRS11a

SEQ ID NO: 41075 - protein, 232 aa, Staphylococcus aureus; identical to SEQ ID NO: 30584
  subsp. aureus VRS11a

SEQ ID NO: 41076 - protein, 227 aa, Staphylococcus aureus; identical to SEQ ID NO: 30585
  subsp. aureus VRS11a

SEQ ID NO: 41077 - protein, 504 aa, Staphylococcus aureus
  subsp. aureus VRS11a
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41078 - protein, 241 aa, Staphylococcus aureus; identical to SEQ ID NO: 30571
  subsp. aureus VRS11a

SEQ ID NO: 41079 - protein, 259 aa, Staphylococcus aureus; identical to SEQ ID NO: 30226
  subsp. aureus VRS11a

SEQ ID NO: 41080 - protein, 268 aa, Staphylococcus aureus; identical to SEQ ID NO: 30398
  subsp. aureus VRS11a

SEQ ID NO: 41081 - protein, 258 aa, Staphylococcus aureus; identical to SEQ ID NO: 30228
  subsp. aureus VRS11a

SEQ ID NO: 41082 - protein, 274 aa, Staphylococcus aureus
  subsp. aureus VRS11a
MKKMILTSLFSATLLFGSFGTTVFADELVPTDSSTPPIEVPTDPSTPVDPTEPTTPVDPVEPPVTPTDPTEPVDPTEPTEPTEPTEPSEPEKPVDPTEPTTPTEPSEPEKPTEPSKPVEPEKPVTPSKPTEPEKPAKPTQPDKPVDVVVTPNGEISHGGNTSQQPTVPIETSNVNEITHVPTPNTPITTSNGESIVAVLDGTPLKQTEEGLKPIQSDFKVLPSGNVEVKGNDGKLKVLPKTGEEMNIFLSAAGGILSLVSGFIFFKKRQSMNNR

SEQ ID NO: 41083 - protein, 243 aa, Staphylococcus aureus
  subsp. aureus VRS11b
FRLSSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41084 - protein, 673 aa, Staphylococcus aureus
  subsp. aureus VRS11b
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESD

SEQ ID NO: 41085 - protein, 2271 aa, Staphylococcus aureus; identical to SEQ ID NO: 30597
  subsp. aureus VRS11b

SEQ ID NO: 41086 - protein, 681 aa, Staphylococcus aureus; identical to SEQ ID NO: 30598
  subsp. aureus VRS11b

SEQ ID NO: 41087 - protein, 321 aa, Staphylococcus aureus; identical to SEQ ID NO: 30959
  subsp. aureus VRS11b

SEQ ID NO: 41088 - protein, 315 aa, Staphylococcus aureus; identical to SEQ ID NO: 30573
  subsp. aureus VRS11b

SEQ ID NO: 41089 - protein, 325 aa, Staphylococcus aureus; identical to SEQ ID NO: 30407
  subsp. aureus VRS11b

SEQ ID NO: 41090 - protein, 859 aa, Staphylococcus aureus; identical to SEQ ID NO: 36568
  subsp. aureus VRS11b

SEQ ID NO: 41091 - protein, 961 aa, Staphylococcus aureus; identical to SEQ ID NO: 30589
  subsp. aureus VRS11b

SEQ ID NO: 41092 - protein, 1038 aa, Staphylococcus aureus; identical to SEQ ID NO: 30590
  subsp. aureus VRS11b

SEQ ID NO: 41093 - protein, 233 aa, Staphylococcus aureus; identical to SEQ ID NO: 30591
  subsp. aureus VRS11b

SEQ ID NO: 41094 - protein, 211 aa, Staphylococcus aureus; identical to SEQ ID NO: 30592
  subsp. aureus VRS11b

SEQ ID NO: 41095 - protein, 180 aa, Staphylococcus aureus
  subsp. aureus VRS11b
AIQTQTAIQIQTATQNQTATQTHDSDSDSDSDSDSDSDSDSDSDSESDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 41096 - protein, 809 aa, Staphylococcus aureus; identical to SEQ ID NO: 30632
  subsp. aureus VRS11b

SEQ ID NO: 41097 - protein, 141 aa, Staphylococcus aureus; identical to SEQ ID NO: 30633
  subsp. aureus VRS11b

SEQ ID NO: 41098 - protein, 2481 aa, Staphylococcus aureus; identical to SEQ ID NO: 41027
  subsp. aureus VRS11b

SEQ ID NO: 41099 - protein, 231 aa, Staphylococcus aureus; identical to SEQ ID NO: 30630
  subsp. aureus VRS11b

SEQ ID NO: 41100 - protein, 96 aa, Staphylococcus aureus; identical to SEQ ID NO: 30813
  subsp. aureus VRS11b

SEQ ID NO: 41101 - protein, 274 aa, Staphylococcus aureus; identical to SEQ ID NO: 30815
  subsp. aureus VRS11b

SEQ ID NO: 41102 - protein, 338 aa, Staphylococcus aureus; identical to SEQ ID NO: 30627
  subsp. aureus VRS11b

SEQ ID NO: 41103 - protein, 351 aa, Staphylococcus aureus; identical to SEQ ID NO: 30628
  subsp. aureus VRS11b

SEQ ID NO: 41104 - protein, 44 aa, Staphylococcus aureus; identical to SEQ ID NO: 30513
  subsp. aureus VRS11b

SEQ ID NO: 41105 - protein, 327 aa, Staphylococcus aureus; identical to SEQ ID NO: 30616
  subsp. aureus VRS11b

SEQ ID NO: 41106 - protein, 311 aa, Staphylococcus aureus; identical to SEQ ID NO: 30617
  subsp. aureus VRS11b

SEQ ID NO: 41107 - protein, 258 aa, Staphylococcus aureus; identical to SEQ ID NO: 30410
  subsp. aureus VRS11b

SEQ ID NO: 41108 - protein, 251 aa, Staphylococcus aureus; identical to SEQ ID NO: 30946
  subsp. aureus VRS11b

SEQ ID NO: 41109 - protein, 131 aa, Staphylococcus aureus; identical to SEQ ID NO: 30867
  subsp. aureus VRS11b

SEQ ID NO: 41110 - protein, 242 aa, Staphylococcus aureus; identical to SEQ ID NO: 30399
  subsp. aureus VRS11b

SEQ ID NO: 41111 - protein, 239 aa, Staphylococcus aureus; identical to SEQ ID NO: 30622
  subsp. aureus VRS11b

SEQ ID NO: 41112 - protein, 254 aa, Staphylococcus aureus; identical to SEQ ID NO: 30809
  subsp. aureus VRS11b

SEQ ID NO: 41113 - protein, 891 aa, Staphylococcus aureus; identical to SEQ ID NO: 30788
  subsp. aureus VRS11b

SEQ ID NO: 41114 - protein, 2186 aa, Staphylococcus aureus; identical to SEQ ID NO: 30789
  subsp. aureus VRS11b

SEQ ID NO: 41115 - protein, 331 aa, Staphylococcus aureus; identical to SEQ ID NO: 30615
  subsp. aureus VRS11b

SEQ ID NO: 41116 - protein, 62 aa, Staphylococcus aureus; identical to SEQ ID NO: 30610
  subsp. aureus VRS11b

SEQ ID NO: 41117 - protein, 157 aa, Staphylococcus aureus; identical to SEQ ID NO: 30611
  subsp. aureus VRS11b

SEQ ID NO: 41118 - protein, 291 aa, Staphylococcus aureus; identical to SEQ ID NO: 30390
  subsp. aureus VRS11b

SEQ ID NO: 41119 - protein, 319 aa, Staphylococcus aureus; identical to SEQ ID NO: 30605
  subsp. aureus VRS11b

SEQ ID NO: 41120 - protein, 238 aa, Staphylococcus aureus; identical to SEQ ID NO: 30606
  subsp. aureus VRS11b

SEQ ID NO: 41121 - protein, 241 aa, Staphylococcus aureus; identical to SEQ ID NO: 30607
  subsp. aureus VRS11b

SEQ ID NO: 41122 - protein, 241 aa, Staphylococcus aureus; identical to SEQ ID NO: 30608
  subsp. aureus VRS11b

SEQ ID NO: 41123 - protein, 372 aa, Staphylococcus aureus; identical to SEQ ID NO: 30609
  subsp. aureus VRS11b

SEQ ID NO: 41124 - protein, 645 aa, Staphylococcus aureus; identical to SEQ ID NO: 30601
  subsp. aureus VRS11b

SEQ ID NO: 41125 - protein, 350 aa, Staphylococcus aureus; identical to SEQ ID NO: 30602
  subsp. aureus VRS11b

SEQ ID NO: 41126 - protein, 109 aa, Staphylococcus aureus; identical to SEQ ID NO: 30603
  subsp. aureus VRS11b

SEQ ID NO: 41127 - protein, 165 aa, Staphylococcus aureus; identical to SEQ ID NO: 30418
  subsp. aureus VRS11b

SEQ ID NO: 41128 - protein, 434 aa, Staphylococcus aureus [sequence omitted]

SEQ ID NO: 41129 - protein, 673 aa, Staphylococcus aureus
  subsp. aureus VRS11b
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSDSDSDSDSDSDSDSDSDSDSDSDSDSDSDSDSDSDSDSDSDSDSDSDSDSDSDSDS

SEQ ID NO: 41130 - protein, 165 aa, Staphylococcus aureus
  subsp. aureus VRS11b
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 41131 - protein, 153 aa, Staphylococcus aureus
  subsp. aureus VRS11b
DSRSDSDSDSDQTATQIQIAIQTQTQIAIQIQTATQIRTSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 41132 - protein, 1019 aa, Staphylococcus aureus
  subsp. aureus VRS11b
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDQTQIATQIQTVTQT

SEQ ID NO: 41133 - protein, 131 aa, Staphylococcus aureus
  subsp. aureus VRS11b
DSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 41134 - protein, 1206 aa, Staphylococcus aureus
  subsp. aureus VRS11b
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 41135 - protein, 804 aa, Staphylococcus aureus
  subsp. aureus VRS11b
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKKLDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSESDSDSDSDSDSDSDSDSDSDSDSDSDSDSDSDSDSDS

SEQ ID NO: 41136 - protein, 227 aa, Staphylococcus aureus; identical to SEQ ID NO: 30586
  subsp. aureus VRS11b

SEQ ID NO: 41137 - protein, 200 aa, Staphylococcus aureus
  subsp. aureus VRS11b
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLK

SEQ ID NO: 41138 - protein, 241 aa, Staphylococcus aureus; identical to SEQ ID NO: 30571
  subsp. aureus VRS11b

SEQ ID NO: 41139 - protein, 691 aa, Staphylococcus aureus; identical to SEQ ID NO: 30511
  subsp. aureus VRS11b

SEQ ID NO: 41140 - protein, 203 aa, Staphylococcus aureus; identical to SEQ ID NO: 30576
  subsp. aureus VRS11b

SEQ ID NO: 41141 - protein, 226 aa, Staphylococcus aureus; identical to SEQ ID NO: 30577
  subsp. aureus VRS11b

SEQ ID NO: 41142 - protein, 231 aa, Staphylococcus aureus; identical to SEQ ID NO: 30578
  subsp. aureus VRS11b

SEQ ID NO: 41143 - protein, 356 aa, Staphylococcus aureus; identical to SEQ ID NO: 30579
  subsp. aureus VRS11b

SEQ ID NO: 41144 - protein, 292 aa, Staphylococcus aureus; identical to SEQ ID NO: 41071
  subsp. aureus VRS11b

SEQ ID NO: 41145 - protein, 234 aa, Staphylococcus aureus; identical to SEQ ID NO: 30581
  subsp. aureus VRS11b

SEQ ID NO: 41146 - protein, 231 aa, Staphylococcus aureus; identical to SEQ ID NO: 30582
  subsp. aureus VRS11b

SEQ ID NO: 41147 - protein, 232 aa, Staphylococcus aureus; identical to SEQ ID NO: 30583
  subsp. aureus VRS11b

SEQ ID NO: 41148 - protein, 232 aa, Staphylococcus aureus; identical to SEQ ID NO: 30584
  subsp. aureus VRS11b

SEQ ID NO: 41149 - protein, 227 aa, Staphylococcus aureus; identical to SEQ ID NO: 30585
  subsp. aureus VRS11b

SEQ ID NO: 41150 - protein, 166 aa, Staphylococcus aureus
  subsp. aureus VRS11b
AKKTATSLVKKTTKNLVKKTATSLVKKTTTNLDKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41151 - protein, 259 aa, Staphylococcus aureus; identical to SEQ ID NO: 30226
  subsp. aureus VRS11b

SEQ ID NO: 41152 - protein, 268 aa, Staphylococcus aureus; identical to SEQ ID NO: 30398
  subsp. aureus VRS11b

SEQ ID NO: 41153 - protein, 258 aa, Staphylococcus aureus; identical to SEQ ID NO: 30228
  subsp. aureus VRS11b

SEQ ID NO: 41154 - protein, 274 aa, Staphylococcus aureus; identical to SEQ ID NO: 41082
  subsp. aureus VRS11b

SEQ ID NO: 41155 - protein, 793 aa, Staphylococcus aureus
  subsp. aureus VRS2
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 41156 - protein, 2137 aa, Staphylococcus aureus
  subsp. aureus VRS2
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSEPLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 41157 - protein, 681 aa, Staphylococcus aureus; identical to SEQ ID NO: 30598
  subsp. aureus VRS2

SEQ ID NO: 41158 - protein, 117 aa, Staphylococcus aureus
  subsp. aureus VRS2
DSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 41159 - protein, 735 aa, Staphylococcus aureus
  subsp. aureus VRS2
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSQLILRVN

SEQ ID NO: 41160 - protein, 233 aa, Staphylococcus aureus; identical to SEQ ID NO: 30591
  subsp. aureus VRS2

SEQ ID NO: 41161 - protein, 181 aa, Staphylococcus aureus
  subsp. aureus VRS2
MNENSNLIPVRQPDANYPGPVSDIARVKKLDNLIDGTKDPDVIKQLKDDNEVPNNAVKAKDSKIVSDCRHLLKHPDNLIDGTKDPNVINQLKNANGTSNNSAVNPSIKANDIHTKSNKQMAKQQSIHLDSKSKSVHKQQLKELPKTGVNNESNTAIMALFIGLILLVVSLVTRFIKLNSHQ

SEQ ID NO: 41162 - protein, 362 aa, Staphylococcus aureus
  subsp. aureus VRS2
MELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 41163 - protein, 706 aa, Staphylococcus aureus
  subsp. aureus VRS2
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGMKVAKIAVISHSRKTQKK

SEQ ID NO: 41164 - protein, 117 aa, Staphylococcus aureus
  subsp. aureus VRS2
SEPETPTPPTPEVPSEPETPTPPTPEVPAEPGKPVPPAKEEPKKPSKPVEQGKVVTPVIEINEKVKAVAPTKQKQSKKSELPETGGEESTNKGMLFGGLFSILGLALLRRNKKNNKA

SEQ ID NO: 41165 - protein, 372 aa, Staphylococcus aureus
  subsp. aureus VRS2
ESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 41166 - protein, 321 aa, Staphylococcus aureus
  subsp. aureus VRS2
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYSYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 41167 - protein, 315 aa, Staphylococcus aureus; identical to SEQ ID NO: 30573
  subsp. aureus VRS2

SEQ ID NO: 41168 - protein, 325 aa, Staphylococcus aureus; identical to SEQ ID NO: 30407
  subsp. aureus VRS2

SEQ ID NO: 41169 - protein, 859 aa, Staphylococcus aureus; identical to SEQ ID NO: 36568
  subsp. aureus VRS2

SEQ ID NO: 41170 - protein, 125 aa, Staphylococcus aureus
  subsp. aureus VRS2
TPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 41171 - protein, 809 aa, Staphylococcus aureus; identical to SEQ ID NO: 30632
  subsp. aureus VRS2

SEQ ID NO: 41172 - protein, 141 aa, Staphylococcus aureus; identical to SEQ ID NO: 30633
  subsp. aureus VRS2

SEQ ID NO: 41173 - protein, 2461 aa, Staphylococcus aureus
  subsp. aureus VRS2
MNLFRQQKFSIRKFNVGIFSALIATVTFISTNPTTASAAEQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQITSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 41174 - protein, 231 aa, Staphylococcus aureus; identical to SEQ ID NO: 30630
  subsp. aureus VRS2

SEQ ID NO: 41175 - protein, 96 aa, Staphylococcus aureus; identical to SEQ ID NO: 30813
  subsp. aureus VRS2

SEQ ID NO: 41176 - protein, 331 aa, Staphylococcus aureus
  subsp. aureus VRS2
MMVKKTKSNSLKKVATLALANLLLVGALTDNSAKAESKKDDTDLKLVSHNVYMLSTVLYPNWGQYKRADLIGQSSYIKKNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNIHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 41177 - protein, 338 aa, Staphylococcus aureus; identical to SEQ ID NO: 30627
  subsp. aureus VRS2

SEQ ID NO: 41178 - protein, 351 aa, Staphylococcus aureus; identical to SEQ ID NO: 30628
  subsp. aureus VRS2

SEQ ID NO: 41179 - protein, 44 aa, Staphylococcus aureus; identical to SEQ ID NO: 30513
  subsp. aureus VRS2

SEQ ID NO: 41180 - protein, 327 aa, Staphylococcus aureus; identical to SEQ ID NO: 30616
  subsp. aureus VRS2

SEQ ID NO: 41181 - protein, 311 aa, Staphylococcus aureus; identical to SEQ ID NO: 30617
  subsp. aureus VRS2

SEQ ID NO: 41182 - protein, 258 aa, Staphylococcus aureus; identical to SEQ ID NO: 30410
  subsp. aureus VRS2

SEQ ID NO: 41183 - protein, 251 aa, Staphylococcus aureus; identical to SEQ ID NO: 30946
  subsp. aureus VRS2

SEQ ID NO: 41184 - protein, 131 aa, Staphylococcus aureus; identical to SEQ ID NO: 30867
  subsp. aureus VRS2

SEQ ID NO: 41185 - protein, 242 aa, Staphylococcus aureus; identical to SEQ ID NO: 30399
  subsp. aureus VRS2

SEQ ID NO: 41186 - protein, 239 aa, Staphylococcus aureus; identical to SEQ ID NO: 30622
  subsp. aureus VRS2

SEQ ID NO: 41187 - protein, 254 aa, Staphylococcus aureus; identical to SEQ ID NO: 30809
  subsp. aureus VRS2

SEQ ID NO: 41188 - protein, 331 aa, Staphylococcus aureus; identical to SEQ ID NO: 30615
  subsp. aureus VRS2

SEQ ID NO: 41189 - protein, 2186 aa, Staphylococcus aureus
  subsp. aureus VRS2
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTTEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASTREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 41190 - protein, 884 aa, Staphylococcus aureus
  subsp. aureus VRS2
MNKHHPKLRSFYSIRKSTLGVASVIVSTLFLITSQHQAQAAENTNTSDKISENQNNNATTTQQPKDTNQTQPATQPVITAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAIKNPAIIDKEHTADNWRPIDFQMKNDKGERQFYHYASTVEPATVIFTKTGPVIELGLKTASTWKKFEVYEGDKKLPVELVSYDSDKDYAYIRFPVSNGTRDVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDNSVGMSSNVDTDKDSNKNKDKVIQLAHIADKNNHTGKAARLDVVKQNYNNTDKVTDKKTTEHLPSDIHKTVDKTVKTKEKAGTPSKENKLSQSKNATKNWRNNFKPIMVGLICVIRYVSFIHS

SEQ ID NO: 41191 - protein, 62 aa, Staphylococcus aureus; identical to SEQ ID NO: 30610
  subsp. aureus VRS2

SEQ ID NO: 41192 - protein, 157 aa, Staphylococcus aureus; identical to SEQ ID NO: 30611
  subsp. aureus VRS2

SEQ ID NO: 41193 - protein, 291 aa, Staphylococcus aureus; identical to SEQ ID NO: 33009
  subsp. aureus VRS2

SEQ ID NO: 41194 - protein, 319 aa, Staphylococcus aureus; identical to SEQ ID NO: 30605
  subsp. aureus VRS2

SEQ ID NO: 41195 - protein, 238 aa, Staphylococcus aureus; identical to SEQ ID NO: 30606
  subsp. aureus VRS2

SEQ ID NO: 41196 - protein, 241 aa, Staphylococcus aureus; identical to SEQ ID NO: 30607
  subsp. aureus VRS2

SEQ ID NO: 41197 - protein, 241 aa, Staphylococcus aureus; identical to SEQ ID NO: 30608
  subsp. aureus VRS2

SEQ ID NO: 41198 - protein, 372 aa, Staphylococcus aureus; identical to SEQ ID NO: 30609
  subsp. aureus VRS2

SEQ ID NO: 41199 - protein, 645 aa, Staphylococcus aureus; identical to SEQ ID NO: 30601
  subsp. aureus VRS2

SEQ ID NO: 41200 - protein, 350 aa, Staphylococcus aureus; identical to SEQ ID NO: 30602
  subsp. aureus VRS2

SEQ ID NO: 41201 - protein, 109 aa, Staphylococcus aureus; identical to SEQ ID NO: 30603
  subsp. aureus VRS2

SEQ ID NO: 41202 - protein, 165 aa, Staphylococcus aureus; identical to SEQ ID NO: 30418
  subsp. aureus VRS2

SEQ ID NO: 41203 - protein, 277 aa, Staphylococcus aureus
  subsp. aureus VRS2
SASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41204 - protein, 434 aa, Staphylococcus aureus [sequence omitted]

SEQ ID NO: 41205 - protein, 630 aa, Staphylococcus aureus
  subsp. aureus VRS2
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSA

SEQ ID NO: 41206 - protein, 42 aa, Staphylococcus aureus; identical to SEQ ID NO: 40919
  subsp. aureus VRS2

SEQ ID NO: 41207 - protein, 1117 aa, Staphylococcus aureus; identical to SEQ ID NO: 32455
  subsp. aureus VRS2

SEQ ID NO: 41208 - protein, 88 aa, Staphylococcus aureus
  subsp. aureus VRS2
SDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 41209 - protein, 1128 aa, Staphylococcus aureus
  subsp. aureus VRS2
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDS

SEQ ID NO: 41210 - protein, 748 aa, Staphylococcus aureus
  subsp. aureus VRS2
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDS

SEQ ID NO: 41211 - protein, 227 aa, Staphylococcus aureus; identical to SEQ ID NO: 30586
  subsp. aureus VRS2

SEQ ID NO: 41212 - protein, 226 aa, Staphylococcus aureus; identical to SEQ ID NO: 30577
  subsp. aureus VRS2

SEQ ID NO: 41213 - protein, 231 aa, Staphylococcus aureus
  subsp. aureus VRS2
MKMKNIAKISLLLGILATGVNTTTEKPVHAEKKPIVISENSKKLKAYYTQPSIEYKNVKGYISFIQPSIKFMNIIDGNSVNNLALIGKDKQHYHTGVHRNLNIFYVNEDKRFEGAKYSIGGITSANDKAVDLIAEARVIKADHIGEYDYDFFPFKIDKEAMSLKEIDFKLRKYLIDNYGLYGEMSTGKITVKKKYYGKYTFELDKKLQEDRMSDVINVTDIDRIEIKVRKA

SEQ ID NO: 41214 - protein, 356 aa, Staphylococcus aureus; identical to SEQ ID NO: 30793
  subsp. aureus VRS2

SEQ ID NO: 41215 - protein, 292 aa, Staphylococcus aureus; identical to SEQ ID NO: 30580
  subsp. aureus VRS2

SEQ ID NO: 41216 - protein, 234 aa, Staphylococcus aureus; identical to SEQ ID NO: 30581
  subsp. aureus VRS2

SEQ ID NO: 41217 - protein, 231 aa, Staphylococcus aureus; identical to SEQ ID NO: 30582
  subsp. aureus VRS2

SEQ ID NO: 41218 - protein, 232 aa, Staphylococcus aureus; identical to SEQ ID NO: 30583
  subsp. aureus VRS2

SEQ ID NO: 41219 - protein, 232 aa, Staphylococcus aureus; identical to SEQ ID NO: 30584
  subsp. aureus VRS2

SEQ ID NO: 41220 - protein, 227 aa, Staphylococcus aureus; identical to SEQ ID NO: 30585
  subsp. aureus VRS2

SEQ ID NO: 41221 - protein, 691 aa, Staphylococcus aureus; identical to SEQ ID NO: 30511
  subsp. aureus VRS2

SEQ ID NO: 41222 - protein, 203 aa, Staphylococcus aureus; identical to SEQ ID NO: 30576
  subsp. aureus VRS2

SEQ ID NO: 41223 - protein, 308 aa, Staphylococcus aureus
  subsp. aureus VRS2
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKNLVNEERTTR

SEQ ID NO: 41224 - protein, 241 aa, Staphylococcus aureus; identical to SEQ ID NO: 30571
  subsp. aureus VRS2

SEQ ID NO: 41225 - protein, 157 aa, Staphylococcus aureus
  subsp. aureus VRS2
KEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41226 - protein, 310 aa, Staphylococcus aureus
  subsp. aureus VRS3a
NHHISHSGLGTENGHGNYGVIEEIEENSHVDIKSELGYEGGQNSGNQSFEEDTEEDKPKYEQGGNIVDIDFDSVPQIHGQNKGDQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKITKH

SEQ ID NO: 41227 - protein, 2239 aa, Staphylococcus aureus
  subsp. aureus VRS3a
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSLSASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 41228 - protein, 681 aa, Staphylococcus aureus; identical to SEQ ID NO: 30598
  subsp. aureus VRS3a

SEQ ID NO: 41229 - protein, 689 aa, Staphylococcus aureus
  subsp. aureus VRS3a
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSD

SEQ ID NO: 41230 - protein, 211 aa, Staphylococcus aureus; identical to SEQ ID NO: 30592
  subsp. aureus VRS3a

SEQ ID NO: 41231 - protein, 233 aa, Staphylococcus aureus; identical to SEQ ID NO: 30591
  subsp. aureus VRS3a

SEQ ID NO: 41232 - protein, 765 aa, Staphylococcus aureus
  subsp. aureus VRS3a
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGN

SEQ ID NO: 41233 - protein, 753 aa, Staphylococcus aureus
  subsp. aureus VRS3a
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEEDKPKYEQGG

SEQ ID NO: 41234 - protein, 444 aa, Staphylococcus aureus; identical to SEQ ID NO: 30588
  subsp. aureus VRS3a

SEQ ID NO: 41235 - protein, 101 aa, Staphylococcus aureus
  subsp. aureus VRS3a
PETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 41236 - protein, 433 aa, Staphylococcus aureus
  subsp. aureus VRS3a
MVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNLETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 41237 - protein, 321 aa, Staphylococcus aureus; identical to SEQ ID NO: 30959
  subsp. aureus VRS3a

SEQ ID NO: 41238 - protein, 315 aa, Staphylococcus aureus; identical to SEQ ID NO: 30573
  subsp. aureus VRS3a

SEQ ID NO: 41239 - protein, 325 aa, Staphylococcus aureus; identical to SEQ ID NO: 30407
  subsp. aureus VRS3a

SEQ ID NO: 41240 - protein, 809 aa, Staphylococcus aureus; identical to SEQ ID NO: 30632
  subsp. aureus VRS3a

SEQ ID NO: 41241 - protein, 141 aa, Staphylococcus aureus; identical to SEQ ID NO: 30633
  subsp. aureus VRS3a

SEQ ID NO: 41242 - protein, 231 aa, Staphylococcus aureus; identical to SEQ ID NO: 30630
  subsp. aureus VRS3a

SEQ ID NO: 41243 - protein, 2481 aa, Staphylococcus aureus
  subsp. aureus VRS3a
MNLFRQQKFSIRKFNVGIFSALIATVTFISTNPTTASAAAQNQPAQNQPAQPADANTQPNANAGAQANPAAQPANQGGQANPAGGAAQPAGQGNQADPNNAAQAQPGNQAAPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGITKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNDSLTTTFPNGNEDSTVLKNMTVNYDQTANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVETANRASQADIDGLVTKLQAALIDNQAAIAELDTKAQEKVTAAQQSKKVTQDEVAALVTKINNDKNNAIAEINKQTTSQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEIFKIENITDSTQTKMDAYKEVRQAATARKAQNATVSNATDEEVAEANAAVDAAQTEGLHDIQVVKSQQEVADTKAKVLDKINAIQTQAKVKPAADTEVENAYNTRKQEIQNSNASTTEEKEAAYTELDAKKQEARTNLDAANTNSDVTTAKDNGIAAINQVQAATTKKSDAKAEIAQKASERKTAIEAMNDSTTEEQQAAKDKVDQAVVTANADIDNATANTDVDNAKTTNEATIAAITPDANVKPAAKQAIADKVQAQETAIDANNGSTTEEKEAAKQQVQTEKTAADAAIDAAHSNVEVEAAKNAEIAKIEAIQPATTTKDNAKQAIATKANERKTAIAQTQDITAEEIAAANADVDNAVTQANSNIEAANSQNDVDQAKTTGETSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATNEEKEAAIQQLATAVTDAKNNITAATDDNGVDTAKDAGKNSIQSTQPATAVKSNAKNEVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALENINNGVDNGDVDDALTQGKAAIDTIQVDATVKPKANQAIEAKAEDTKESIDHSDQLTAEEKTEALAMIKQITDQAKQGITDATTTAEVEKAKAQGLEAFDNIQIDSTEKQKAIEELETALDQIEAGVNVDADATTEEKEAFTNALEDILSKATEDISDQTTNAEIATVKNSALEQLKAQRINPVVKKNALEAIREVVNKQIEIIKNADADASAKEIARTDLGRYFDRFADKLDKTQTNTEVAELQNVTIPAIEAIVPQNDPDANDTNNGTDNNDATANSNANATPENTGQPNVSETTDNGKADASPTTPNNSDAATGETTVTSATDDAKDKPQANNNSSADASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNGKVAQPKSENKAKAEKDGRDSTNQSMVESTTETLPSADITEPNVPSNTSKDKEESTTNQTDAGQLKSETNVASNEADKSPSKADTEVSNKPSTSASSEAKDKMTSTNVSQKDDTATADTNDTQKSVGPVANNKAKDMQTNDTQKSVGSAANNKATQNDGANASPATVSNGSHSMHQDMLNVTKPEENKANAKSDQQGKVNKPKQQAKTLPDTGMSHNDDLPYAELALGAGMAFLIRRFTKKDQQTEE

SEQ ID NO: 41244 - protein, 44 aa, Staphylococcus aureus; identical to SEQ ID NO: 30513
  subsp. aureus VRS3a

SEQ ID NO: 41245 - protein, 96 aa, Staphylococcus aureus; identical to SEQ ID NO: 30813
  subsp. aureus VRS3a

SEQ ID NO: 41246 - protein, 331 aa, Staphylococcus aureus
  subsp. aureus VRS3a
MMVKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKTYSK

SEQ ID NO: 41247 - protein, 338 aa, Staphylococcus aureus; identical to SEQ ID NO: 30627
  subsp. aureus VRS3a

SEQ ID NO: 41248 - protein, 351 aa, Staphylococcus aureus; identical to SEQ ID NO: 30628
  subsp. aureus VRS3a

SEQ ID NO: 41249 - protein, 327 aa, Staphylococcus aureus; identical to SEQ ID NO: 30616
  subsp. aureus VRS3a

SEQ ID NO: 41250 - protein, 311 aa, Staphylococcus aureus; identical to SEQ ID NO: 30617
  subsp. aureus VRS3a

SEQ ID NO: 41251 - protein, 258 aa, Staphylococcus aureus; identical to SEQ ID NO: 30410
  subsp. aureus VRS3a

SEQ ID NO: 41252 - protein, 251 aa, Staphylococcus aureus; identical to SEQ ID NO: 30946
  subsp. aureus VRS3a

SEQ ID NO: 41253 - protein, 131 aa, Staphylococcus aureus; identical to SEQ ID NO: 30867
  subsp. aureus VRS3a

SEQ ID NO: 41254 - protein, 242 aa, Staphylococcus aureus; identical to SEQ ID NO: 30399
  subsp. aureus VRS3a

SEQ ID NO: 41255 - protein, 239 aa, Staphylococcus aureus; identical to SEQ ID NO: 30622
  subsp. aureus VRS3a

SEQ ID NO: 41256 - protein, 254 aa, Staphylococcus aureus; identical to SEQ ID NO: 30809
  subsp. aureus VRS3a

SEQ ID NO: 41257 - protein, 291 aa, Staphylococcus aureus; identical to SEQ ID NO: 33009
  subsp. aureus VRS3a

SEQ ID NO: 41258 - protein, 891 aa, Staphylococcus aureus; identical to SEQ ID NO: 30788
  subsp. aureus VRS3a

SEQ ID NO: 41259 - protein, 2186 aa, Staphylococcus aureus
  subsp. aureus VRS3a
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGIEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNAGVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIEKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKEQAINQINQNQTNDQVDTTTNQAVNAIDNVEAEVVIKPKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 41260 - protein, 331 aa, Staphylococcus aureus; identical to SEQ ID NO: 30615
  subsp. aureus VRS3a

SEQ ID NO: 41261 - protein, 62 aa, Staphylococcus aureus; identical to SEQ ID NO: 30610
  subsp. aureus VRS3a

SEQ ID NO: 41262 - protein, 157 aa, Staphylococcus aureus; identical to SEQ ID NO: 30611
  subsp. aureus VRS3a

SEQ ID NO: 41263 - protein, 319 aa, Staphylococcus aureus; identical to SEQ ID NO: 30605
  subsp. aureus VRS3a

SEQ ID NO: 41264 - protein, 238 aa, Staphylococcus aureus; identical to SEQ ID NO: 30606
  subsp. aureus VRS3a

SEQ ID NO: 41265 - protein, 241 aa, Staphylococcus aureus; identical to SEQ ID NO: 30607
  subsp. aureus VRS3a

SEQ ID NO: 41266 - protein, 241 aa, Staphylococcus aureus
  subsp. aureus VRS3a
MKKNIMNKLVLSTALLLLGTTSTLLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPKNAQIEVILEKSN

SEQ ID NO: 41267 - protein, 372 aa, Staphylococcus aureus; identical to SEQ ID NO: 30609
  subsp. aureus VRS3a

SEQ ID NO: 41268 - protein, 642 aa, Staphylococcus aureus
  subsp. aureus VRS3a
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKAPKETKAVKPAAKATNNTYPILNQELREAIKNPAIKDKDHSAPNSRPIDFEMKKENGEQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYIVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 41269 - protein, 350 aa, Staphylococcus aureus; identical to SEQ ID NO: 30602
  subsp. aureus VRS3a

SEQ ID NO: 41270 - protein, 109 aa, Staphylococcus aureus; identical to SEQ ID NO: 30603
  subsp. aureus VRS3a

SEQ ID NO: 41271 - protein, 165 aa, Staphylococcus aureus; identical to SEQ ID NO: 30418
  subsp. aureus VRS3a

SEQ ID NO: 41272 - protein, 211 aa, Staphylococcus aureus
  subsp. aureus VRS3a
QRVDSDSASDSDSDSDSDSDSDSDSDSDSDSDSDSDSDSDSDSDSDSDSDSDSDSDSDSDSDSDSDSASDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41273 - protein, 633 aa, Staphylococcus aureus
  subsp. aureus VRS3a
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPTTTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDQ

SEQ ID NO: 41274 - protein, 434 aa, Staphylococcus aureus [sequence omitted]

SEQ ID NO: 41275 - protein, 95 aa, Staphylococcus aureus
  subsp. aureus VRS3a
DSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 41276 - protein, 140 aa, Staphylococcus aureus
  subsp. aureus VRS3a
SDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 41277 - protein, 961 aa, Staphylococcus aureus
  subsp. aureus VRS3a
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSD

SEQ ID NO: 41278 - protein, 122 aa, Staphylococcus aureus
  subsp. aureus VRS3a
SDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 41279 - protein, 1190 aa, Staphylococcus aureus
  subsp. aureus VRS3a
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKVVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDS

SEQ ID NO: 41280 - protein, 678 aa, Staphylococcus aureus
  subsp. aureus VRS3a
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLT

SEQ ID NO: 41281 - protein, 227 aa, Staphylococcus aureus; identical to SEQ ID NO: 30586
  subsp. aureus VRS3a

SEQ ID NO: 41282 - protein, 226 aa, Staphylococcus aureus; identical to SEQ ID NO: 30577
  subsp. aureus VRS3a

SEQ ID NO: 41283 - protein, 231 aa, Staphylococcus aureus; identical to SEQ ID NO: 30578
  subsp. aureus VRS3a

SEQ ID NO: 41284 - protein, 356 aa, Staphylococcus aureus; identical to SEQ ID NO: 30793
  subsp. aureus VRS3a

SEQ ID NO: 41285 - protein, 292 aa, Staphylococcus aureus; identical to SEQ ID NO: 30580
  subsp. aureus VRS3a

SEQ ID NO: 41286 - protein, 234 aa, Staphylococcus aureus; identical to SEQ ID NO: 30581
  subsp. aureus VRS3a

SEQ ID NO: 41287 - protein, 231 aa, Staphylococcus aureus
  subsp. aureus VRS3a
MKLKTLAKATLALGLLTTGVITSEGQAVHAKEKQERVQHLYDIKDLYRYYSSESFEFSNISGKVENYNGSNVVRFNQEKQKHQLFLLGKDKDKYKKGLEGQNVFVVKELIDPNGRLSTVGGVTKKNNKSSETNTHLFVNKVYGGNLDASIDSFLINKEEVSLKELDFKIRKQLVEKYGLYKGTTKYGKITINLKDEKKEVIDLGDKLQFERMGDVLNSKDIQNIAVTINQI

SEQ ID NO: 41288 - protein, 232 aa, Staphylococcus aureus; identical to SEQ ID NO: 30583
  subsp. aureus VRS3a

SEQ ID NO: 41289 - protein, 232 aa, Staphylococcus aureus; identical to SEQ ID NO: 30584
  subsp. aureus VRS3a

SEQ ID NO: 41290 - protein, 227 aa, Staphylococcus aureus; identical to SEQ ID NO: 30585
  subsp. aureus VRS3a

SEQ ID NO: 41291 - protein, 691 aa, Staphylococcus aureus; identical to SEQ ID NO: 30511
  subsp. aureus VRS3a

SEQ ID NO: 41292 - protein, 203 aa, Staphylococcus aureus; identical to SEQ ID NO: 30576
  subsp. aureus VRS3a

SEQ ID NO: 41293 - protein, 172 aa, Staphylococcus aureus
  subsp. aureus VRS3a
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNT

SEQ ID NO: 41294 - protein, 241 aa, Staphylococcus aureus; identical to SEQ ID NO: 30571
  subsp. aureus VRS3a

SEQ ID NO: 41295 - protein, 159 aa, Staphylococcus aureus
  subsp. aureus VRS3a
LGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41296 - protein, 231 aa, Staphylococcus aureus
  subsp. aureus VRS4
MKKIALLTLFSTALLVSAPLVSFADEATGSSGVNVLADDVVDPVEPTDPTTPVDPVDPVDPVDPVDPVDPTEPTEPTEPTEPTEPTEPTEPTEPTEPTEPTEPTEPTEPTEPTEPSKPTEPTEPSKPTEPTEPSKPVDTNPIENPVNTDTGVVIVAVEDSKPIIQLADGTTKKVEAKEIGANVQKDGTVTVKGTDGKMKVLPKTGETTNVALSVLGSFMVLVSGLIFKKRI

SEQ ID NO: 41297 - protein, 648 aa, Staphylococcus aureus
  subsp. aureus VRS4
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSES

SEQ ID NO: 41298 - protein, 2271 aa, Staphylococcus aureus; identical to SEQ ID NO: 30597
  subsp. aureus VRS4

SEQ ID NO: 41299 - protein, 681 aa, Staphylococcus aureus; identical to SEQ ID NO: 30598
  subsp. aureus VRS4

SEQ ID NO: 41300 - protein, 889 aa, Staphylococcus aureus
  subsp. aureus VRS4
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPNRHR

SEQ ID NO: 41301 - protein, 233 aa, Staphylococcus aureus; identical to SEQ ID NO: 30591
  subsp. aureus VRS4

SEQ ID NO: 41302 - protein, 211 aa, Staphylococcus aureus; identical to SEQ ID NO: 30592
  subsp. aureus VRS4

SEQ ID NO: 41303 - protein, 97 aa, Staphylococcus aureus; identical to SEQ ID NO: 32876
  subsp. aureus VRS4

SEQ ID NO: 41304 - protein, 864 aa, Staphylococcus aureus
  subsp. aureus VRS4
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETP

SEQ ID NO: 41305 - protein, 81 aa, Staphylococcus aureus
  subsp. aureus VRS4
HRKEEPKKPSKPVEQGKVVTPVIEINEKVKAVAPTKKTQSKKSELPETGGEESTNKGMLFGGLFSILGLALLRRNKKNNKA

SEQ ID NO: 41306 - protein, 859 aa, Staphylococcus aureus; identical to SEQ ID NO: 36568
  subsp. aureus VRS4

SEQ ID NO: 41307 - protein, 106 aa, Staphylococcus aureus
  subsp. aureus VRS4
EVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 41308 - protein, 321 aa, Staphylococcus aureus; identical to SEQ ID NO: 30959
  subsp. aureus VRS4

SEQ ID NO: 41309 - protein, 315 aa, Staphylococcus aureus; identical to SEQ ID NO: 30573
  subsp. aureus VRS4

SEQ ID NO: 41310 - protein, 325 aa, Staphylococcus aureus; identical to SEQ ID NO: 30407
  subsp. aureus VRS4

SEQ ID NO: 41311 - protein, 809 aa, Staphylococcus aureus; identical to SEQ ID NO: 30632
  subsp. aureus VRS4

SEQ ID NO: 41312 - protein, 141 aa, Staphylococcus aureus; identical to SEQ ID NO: 30633
  subsp. aureus VRS4

SEQ ID NO: 41313 - protein, 2481 aa, Staphylococcus aureus; identical to SEQ ID NO: 30631
  subsp. aureus VRS4

SEQ ID NO: 41314 - protein, 231 aa, Staphylococcus aureus; identical to SEQ ID NO: 30630
  subsp. aureus VRS4

SEQ ID NO: 41315 - protein, 274 aa, Staphylococcus aureus; identical to SEQ ID NO: 30815
  subsp. aureus VRS4

SEQ ID NO: 41316 - protein, 338 aa, Staphylococcus aureus; identical to SEQ ID NO: 30627
  subsp. aureus VRS4

SEQ ID NO: 41317 - protein, 351 aa, Staphylococcus aureus; identical to SEQ ID NO: 30628
  subsp. aureus VRS4

SEQ ID NO: 41318 - protein, 44 aa, Staphylococcus aureus; identical to SEQ ID NO: 30513
  subsp. aureus VRS4

SEQ ID NO: 41319 - protein, 96 aa, Staphylococcus aureus; identical to SEQ ID NO: 30813
  subsp. aureus VRS4

SEQ ID NO: 41320 - protein, 327 aa, Staphylococcus aureus; identical to SEQ ID NO: 32883
  subsp. aureus VRS4

SEQ ID NO: 41321 - protein, 311 aa, Staphylococcus aureus; identical to SEQ ID NO: 30617
  subsp. aureus VRS4

SEQ ID NO: 41322 - protein, 258 aa, Staphylococcus aureus; identical to SEQ ID NO: 30410
  subsp. aureus VRS4

SEQ ID NO: 41323 - protein, 251 aa, Staphylococcus aureus
  subsp. aureus VRS4
MRLFYIAAIIITLLCLINNNYVNAEVDKKDLKKKSDLDSSKLFNLTSYYTDITWQLDESNKISTDQLLNNTIILKNIDISVLKTSSLKVEFNSSDLANQFKGKNIDIYGLYFGNKCVGLTEEKTSCLYGGVTIHDGNQLDEEKVIGVNVFKDGVQQEGFVIKTKKAKVTVQELDTKVRFKLENLYKIYNKDTGNIQKGCIFFHSHNHQDQSFYYDLCNVKGSVGAEFFQFYSDNRTVSSSNYHIDVFLYKD

SEQ ID NO: 41324 - protein, 131 aa, Staphylococcus aureus; identical to SEQ ID NO: 30867
  subsp. aureus VRS4

SEQ ID NO: 41325 - protein, 242 aa, Staphylococcus aureus; identical to SEQ ID NO: 30399
  subsp. aureus VRS4

SEQ ID NO: 41326 - protein, 239 aa, Staphylococcus aureus; identical to SEQ ID NO: 30622
  subsp. aureus VRS4

SEQ ID NO: 41327 - protein, 254 aa, Staphylococcus aureus; identical to SEQ ID NO: 30809
  subsp. aureus VRS4

SEQ ID NO: 41328 - protein, 891 aa, Staphylococcus aureus; identical to SEQ ID NO: 30788
  subsp. aureus VRS4

SEQ ID NO: 41329 - protein, 2186 aa, Staphylococcus aureus; identical to SEQ ID NO: 30789
  subsp. aureus VRS4

SEQ ID NO: 41330 - protein, 331 aa, Staphylococcus aureus; identical to SEQ ID NO: 30615
  subsp. aureus VRS4

SEQ ID NO: 41331 - protein, 291 aa, Staphylococcus aureus; identical to SEQ ID NO: 31911
  subsp. aureus VRS4

SEQ ID NO: 41332 - protein, 62 aa, Staphylococcus aureus; identical to SEQ ID NO: 30610
  subsp. aureus VRS4

SEQ ID NO: 41333 - protein, 157 aa, Staphylococcus aureus; identical to SEQ ID NO: 30611
  subsp. aureus VRS4

SEQ ID NO: 41334 - protein, 372 aa, Staphylococcus aureus; identical to SEQ ID NO: 30609
  subsp. aureus VRS4

SEQ ID NO: 41335 - protein, 238 aa, Staphylococcus aureus; identical to SEQ ID NO: 30606
  subsp. aureus VRS4

SEQ ID NO: 41336 - protein, 241 aa, Staphylococcus aureus; identical to SEQ ID NO: 30607
  subsp. aureus VRS4

SEQ ID NO: 41337 - protein, 241 aa, Staphylococcus aureus; identical to SEQ ID NO: 30608
  subsp. aureus VRS4

SEQ ID NO: 41338 - protein, 319 aa, Staphylococcus aureus; identical to SEQ ID NO: 30605
  subsp. aureus VRS4

SEQ ID NO: 41339 - protein, 645 aa, Staphylococcus aureus; identical to SEQ ID NO: 30601
  subsp. aureus VRS4

SEQ ID NO: 41340 - protein, 350 aa, Staphylococcus aureus; identical to SEQ ID NO: 30602
  subsp. aureus VRS4

SEQ ID NO: 41341 - protein, 109 aa, Staphylococcus aureus; identical to SEQ ID NO: 30603
  subsp. aureus VRS4

SEQ ID NO: 41342 - protein, 165 aa, Staphylococcus aureus; identical to SEQ ID NO: 30418
  subsp. aureus VRS4

SEQ ID NO: 41343 - protein, 210 aa, Staphylococcus aureus
  subsp. aureus VRS4
DSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41344 - protein, 434 aa, Staphylococcus aureus [sequence omitted]

SEQ ID NO: 41345 - protein, 639 aa, Staphylococcus aureus
  subsp. aureus VRS4
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDS

SEQ ID NO: 41346 - protein, 145 aa, Staphylococcus aureus
  subsp. aureus VRS4
TDHDDFTLDNGYFEEDTSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 41347 - protein, 51 aa, Staphylococcus aureus; identical to SEQ ID NO: 32234
  subsp. aureus VRS4

SEQ ID NO: 41348 - protein, 976 aa, Staphylococcus aureus; identical to SEQ ID NO: 32414
  subsp. aureus VRS4

SEQ ID NO: 41349 - protein, 78 aa, Staphylococcus aureus
  subsp. aureus VRS4
SDSDSDSDSDSDSDSDSDAGKHTPTKPMSTVKDQHKTAKALPETGSENNNSNNGTLFGGLFAALGSLLLFGRRKKQNK

SEQ ID NO: 41350 - protein, 1151 aa, Staphylococcus aureus
  subsp. aureus VRS4
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSD

SEQ ID NO: 41351 - protein, 786 aa, Staphylococcus aureus; identical to SEQ ID NO: 39712
  subsp. aureus VRS4

SEQ ID NO: 41352 - protein, 227 aa, Staphylococcus aureus; identical to SEQ ID NO: 30586
  subsp. aureus VRS4

SEQ ID NO: 41353 - protein, 691 aa, Staphylococcus aureus; identical to SEQ ID NO: 30511
  subsp. aureus VRS4

SEQ ID NO: 41354 - protein, 203 aa, Staphylococcus aureus; identical to SEQ ID NO: 30576
  subsp. aureus VRS4

SEQ ID NO: 41355 - protein, 226 aa, Staphylococcus aureus; identical to SEQ ID NO: 30577
  subsp. aureus VRS4

SEQ ID NO: 41356 - protein, 231 aa, Staphylococcus aureus; identical to SEQ ID NO: 30578
  subsp. aureus VRS4

SEQ ID NO: 41357 - protein, 356 aa, Staphylococcus aureus; identical to SEQ ID NO: 30579
  subsp. aureus VRS4

SEQ ID NO: 41358 - protein, 292 aa, Staphylococcus aureus; identical to SEQ ID NO: 30580
  subsp. aureus VRS4

SEQ ID NO: 41359 - protein, 234 aa, Staphylococcus aureus; identical to SEQ ID NO: 30581
  subsp. aureus VRS4

SEQ ID NO: 41360 - protein, 231 aa, Staphylococcus aureus; identical to SEQ ID NO: 30582
  subsp. aureus VRS4

SEQ ID NO: 41361 - protein, 232 aa, Staphylococcus aureus; identical to SEQ ID NO: 30583
  subsp. aureus VRS4

SEQ ID NO: 41362 - protein, 232 aa, Staphylococcus aureus; identical to SEQ ID NO: 30584
  subsp. aureus VRS4

SEQ ID NO: 41363 - protein, 227 aa, Staphylococcus aureus; identical to SEQ ID NO: 30585
  subsp. aureus VRS4

SEQ ID NO: 41364 - protein, 246 aa, Staphylococcus aureus
  subsp. aureus VRS4
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILHLPNLTEEQRNGFIQSLKDDPSVSKEILAEAKKLNDAQAPKEEDNKKPGKEDGNKPGKEDGNKP

SEQ ID NO: 41365 - protein, 241 aa, Staphylococcus aureus; identical to SEQ ID NO: 30571
  subsp. aureus VRS4

SEQ ID NO: 41366 - protein, 139 aa, Staphylococcus aureus
  subsp. aureus VRS4
DNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41367 - protein, 216 aa, Staphylococcus aureus; identical to SEQ ID NO: 40939
  subsp. aureus VRS5

SEQ ID NO: 41368 - protein, 639 aa, Staphylococcus aureus
  subsp. aureus VRS5
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSD

SEQ ID NO: 41369 - protein, 2234 aa, Staphylococcus aureus
  subsp. aureus VRS5
MFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPVVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASAFLSESLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSNISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 41370 - protein, 681 aa, Staphylococcus aureus; identical to SEQ ID NO: 30598
  subsp. aureus VRS5

SEQ ID NO: 41371 - protein, 779 aa, Staphylococcus aureus
  subsp. aureus VRS5
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHG

SEQ ID NO: 41372 - protein, 233 aa, Staphylococcus aureus; identical to SEQ ID NO: 30591
  subsp. aureus VRS5

SEQ ID NO: 41373 - protein, 91 aa, Staphylococcus aureus
  subsp. aureus VRS5
MKNANGTSNNSAVNPSIKANDIHTKSNKQMAKQQSIHLDSKSKSVHKQQLKELPKTGVNNESNTAIMALFIGLILLVVSLVTRFIKLNSHQ

SEQ ID NO: 41374 - protein, 69 aa, Staphylococcus aureus; identical to SEQ ID NO: 32801
  subsp. aureus VRS5

SEQ ID NO: 41375 - protein, 740 aa, Staphylococcus aureus
  subsp. aureus VRS5
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEE

SEQ ID NO: 41376 - protein, 78 aa, Staphylococcus aureus
  subsp. aureus VRS5
EEPKKPSKPVEQGKVVTPVIEINEKVKAVAPTKKAQSKKSELPETGGEESTNKGMLFGGLFSILGLALLRRNKKNNKA

SEQ ID NO: 41377 - protein, 809 aa, Staphylococcus aureus; identical to SEQ ID NO: 30632
  subsp. aureus VRS5

SEQ ID NO: 41378 - protein, 141 aa, Staphylococcus aureus; identical to SEQ ID NO: 30633
  subsp. aureus VRS5

SEQ ID NO: 41379 - protein, 321 aa, Staphylococcus aureus; identical to SEQ ID NO: 30959
  subsp. aureus VRS5

SEQ ID NO: 41380 - protein, 315 aa, Staphylococcus aureus; identical to SEQ ID NO: 30573
  subsp. aureus VRS5

SEQ ID NO: 41381 - protein, 325 aa, Staphylococcus aureus; identical to SEQ ID NO: 30407
  subsp. aureus VRS5

SEQ ID NO: 41382 - protein, 859 aa, Staphylococcus aureus; identical to SEQ ID NO: 38192
  subsp. aureus VRS5

SEQ ID NO: 41383 - protein, 88 aa, Staphylococcus aureus
  subsp. aureus VRS5
EPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 41384 - protein, 2481 aa, Staphylococcus aureus; identical to SEQ ID NO: 30631
  subsp. aureus VRS5

SEQ ID NO: 41385 - protein, 231 aa, Staphylococcus aureus; identical to SEQ ID NO: 30630
  subsp. aureus VRS5

SEQ ID NO: 41386 - protein, 274 aa, Staphylococcus aureus; identical to SEQ ID NO: 30815
  subsp. aureus VRS5

SEQ ID NO: 41387 - protein, 338 aa, Staphylococcus aureus; identical to SEQ ID NO: 30627
  subsp. aureus VRS5

SEQ ID NO: 41388 - protein, 351 aa, Staphylococcus aureus; identical to SEQ ID NO: 30628
  subsp. aureus VRS5

SEQ ID NO: 41389 - protein, 44 aa, Staphylococcus aureus; identical to SEQ ID NO: 30513
  subsp. aureus VRS5

SEQ ID NO: 41390 - protein, 96 aa, Staphylococcus aureus; identical to SEQ ID NO: 30813
  subsp. aureus VRS5

SEQ ID NO: 41391 - protein, 327 aa, Staphylococcus aureus; identical to SEQ ID NO: 30616
  subsp. aureus VRS5

SEQ ID NO: 41392 - protein, 311 aa, Staphylococcus aureus; identical to SEQ ID NO: 30617
  subsp. aureus VRS5

SEQ ID NO: 41393 - protein, 258 aa, Staphylococcus aureus; identical to SEQ ID NO: 30410
  subsp. aureus VRS5

SEQ ID NO: 41394 - protein, 251 aa, Staphylococcus aureus; identical to SEQ ID NO: 30946
  subsp. aureus VRS5

SEQ ID NO: 41395 - protein, 131 aa, Staphylococcus aureus; identical to SEQ ID NO: 30867
  subsp. aureus VRS5

SEQ ID NO: 41396 - protein, 242 aa, Staphylococcus aureus; identical to SEQ ID NO: 30399
  subsp. aureus VRS5

SEQ ID NO: 41397 - protein, 239 aa, Staphylococcus aureus; identical to SEQ ID NO: 30622
  subsp. aureus VRS5

SEQ ID NO: 41398 - protein, 254 aa, Staphylococcus aureus; identical to SEQ ID NO: 30809
  subsp. aureus VRS5

SEQ ID NO: 41399 - protein, 331 aa, Staphylococcus aureus; identical to SEQ ID NO: 30615
  subsp. aureus VRS5

SEQ ID NO: 41400 - protein, 2186 aa, Staphylococcus aureus
  subsp. aureus VRS5
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSNEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 41401 - protein, 891 aa, Staphylococcus aureus; identical to SEQ ID NO: 30788
  subsp. aureus VRS5

SEQ ID NO: 41402 - protein, 291 aa, Staphylococcus aureus; identical to SEQ ID NO: 30390
  subsp. aureus VRS5

SEQ ID NO: 41403 - protein, 62 aa, Staphylococcus aureus; identical to SEQ ID NO: 30610
  subsp. aureus VRS5

SEQ ID NO: 41404 - protein, 157 aa, Staphylococcus aureus; identical to SEQ ID NO: 30611
  subsp. aureus VRS5

SEQ ID NO: 41405 - protein, 319 aa, Staphylococcus aureus; identical to SEQ ID NO: 30605
  subsp. aureus VRS5

SEQ ID NO: 41406 - protein, 238 aa, Staphylococcus aureus; identical to SEQ ID NO: 30606
  subsp. aureus VRS5

SEQ ID NO: 41407 - protein, 241 aa, Staphylococcus aureus; identical to SEQ ID NO: 30607
  subsp. aureus VRS5

SEQ ID NO: 41408 - protein, 241 aa, Staphylococcus aureus; identical to SEQ ID NO: 30608
  subsp. aureus VRS5

SEQ ID NO: 41409 - protein, 372 aa, Staphylococcus aureus; identical to SEQ ID NO: 30609
  subsp. aureus VRS5

SEQ ID NO: 41410 - protein, 645 aa, Staphylococcus aureus; identical to SEQ ID NO: 30601
  subsp. aureus VRS5

SEQ ID NO: 41411 - protein, 350 aa, Staphylococcus aureus; identical to SEQ ID NO: 30602
  subsp. aureus VRS5

SEQ ID NO: 41412 - protein, 109 aa, Staphylococcus aureus; identical to SEQ ID NO: 30603
  subsp. aureus VRS5

SEQ ID NO: 41413 - protein, 165 aa, Staphylococcus aureus; identical to SEQ ID NO: 30418
  subsp. aureus VRS5

SEQ ID NO: 41414 - protein, 176 aa, Staphylococcus aureus
  subsp. aureus VRS5
DSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41415 - protein, 434 aa, Staphylococcus aureus [sequence omitted]

SEQ ID NO: 41416 - protein, 611 aa, Staphylococcus aureus
  subsp. aureus VRS5
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDS

SEQ ID NO: 41417 - protein, 78 aa, Staphylococcus aureus
  subsp. aureus VRS5
SDSDSDSDSDSDSDSDSDAGKHTPVKPMSTTKDHHNKAKALPETGSENNGSNNATLFGGLFAALGSLLLFGRRKKQNK

SEQ ID NO: 41418 - protein, 103 aa, Staphylococcus aureus
  subsp. aureus VRS5
DSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 41419 - protein, 982 aa, Staphylococcus aureus; identical to SEQ ID NO: 34478
  subsp. aureus VRS5

SEQ ID NO: 41420 - protein, 98 aa, Staphylococcus aureus; identical to SEQ ID NO: 39440
  subsp. aureus VRS5

SEQ ID NO: 41421 - protein, 1142 aa, Staphylococcus aureus
  subsp. aureus VRS5
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDS

SEQ ID NO: 41422 - protein, 786 aa, Staphylococcus aureus; identical to SEQ ID NO: 39712
  subsp. aureus VRS5

SEQ ID NO: 41423 - protein, 227 aa, Staphylococcus aureus; identical to SEQ ID NO: 30586
  subsp. aureus VRS5

SEQ ID NO: 41424 - protein, 691 aa, Staphylococcus aureus; identical to SEQ ID NO: 30511
  subsp. aureus VRS5

SEQ ID NO: 41425 - protein, 203 aa, Staphylococcus aureus; identical to SEQ ID NO: 30576
  subsp. aureus VRS5

SEQ ID NO: 41426 - protein, 226 aa, Staphylococcus aureus; identical to SEQ ID NO: 30577
  subsp. aureus VRS5

SEQ ID NO: 41427 - protein, 231 aa, Staphylococcus aureus; identical to SEQ ID NO: 30578
  subsp. aureus VRS5

SEQ ID NO: 41428 - protein, 356 aa, Staphylococcus aureus; identical to SEQ ID NO: 30579
  subsp. aureus VRS5

SEQ ID NO: 41429 - protein, 292 aa, Staphylococcus aureus; identical to SEQ ID NO: 30580
  subsp. aureus VRS5

SEQ ID NO: 41430 - protein, 234 aa, Staphylococcus aureus; identical to SEQ ID NO: 30581
  subsp. aureus VRS5

SEQ ID NO: 41431 - protein, 231 aa, Staphylococcus aureus; identical to SEQ ID NO: 30582
  subsp. aureus VRS5

SEQ ID NO: 41432 - protein, 232 aa, Staphylococcus aureus; identical to SEQ ID NO: 30583
  subsp. aureus VRS5

SEQ ID NO: 41433 - protein, 232 aa, Staphylococcus aureus; identical to SEQ ID NO: 30584
  subsp. aureus VRS5

SEQ ID NO: 41434 - protein, 227 aa, Staphylococcus aureus; identical to SEQ ID NO: 30585
  subsp. aureus VRS5

SEQ ID NO: 41435 - protein, 318 aa, Staphylococcus aureus
  subsp. aureus VRS5
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKKPGKEERQ

SEQ ID NO: 41436 - protein, 241 aa, Staphylococcus aureus; identical to SEQ ID NO: 30571
  subsp. aureus VRS5

SEQ ID NO: 41437 - protein, 155 aa, Staphylococcus aureus
  subsp. aureus VRS5
DNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41438 - protein, 660 aa, Staphylococcus aureus
  subsp. aureus VRS6
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSESDSESDSDSDSDSDSDSDS

SEQ ID NO: 41439 - protein, 2234 aa, Staphylococcus aureus; identical to SEQ ID NO: 41369
  subsp. aureus VRS6

SEQ ID NO: 41440 - protein, 468 aa, Staphylococcus aureus
  subsp. aureus VRS6
MMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKNSSLNNKNIQRDTTKNNNANPSDVNQGLEQAINDGKQSKVASQQQSKEVDNSQDSNANNNLPSQSLTKEAPSLNKSDQTSQREIVNETEIEKVQPQQNNQANDKITNHNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNNDNMISSITTLGTPMVHTHQI

SEQ ID NO: 41441 - protein, 211 aa, Staphylococcus aureus; identical to SEQ ID NO: 30592
  subsp. aureus VRS6

SEQ ID NO: 41442 - protein, 256 aa, Staphylococcus aureus
  subsp. aureus VRS6
FTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 41443 - protein, 233 aa, Staphylococcus aureus; identical to SEQ ID NO: 30591
  subsp. aureus VRS6

SEQ ID NO: 41444 - protein, 732 aa, Staphylococcus aureus
  subsp. aureus VRS6
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDI

SEQ ID NO: 41445 - protein, 635 aa, Staphylococcus aureus
  subsp. aureus VRS6
MKSNLRYGIRKHKLGAASVFLGTMIVVGMGQEKEAAASEQNNTTVEESGSSATESKASETQTTTNNVNTIDETQSYSATSTEQPSKSTQVTTEEAPTTVQAPKVETEMKSQEDLPSEKVADKETTGTQVDIAQPSNVSEIKPRMKRSADVTAVSEKEVAEEAKATGTDVTNKVEVTESSLEGHNKDSNIVNPHNAQRVTLKYKWKFGEGIKAGDYFDFTLSDNVETHGISTLRKVPEIKSSTEDKVMANGQVINERTIRYTFTDYINNKKDLTAELNLNLFIDPTTVTKQGSQKVEVTLGQNKVSKEFDIKYLDGVKDRMGVTVNGRIDTLNKEEGKFSHFAYVKPNNQSLTSVTVTGQVTSGYKQSANNPTVKVYKHIGSDELAESVYAKLDDTSKFEDVTEKVNLSYTSNGGYTLNLGDLDNSKDYVIKYEGEYDQNAKDLNFRTHLSGYHKYYPYYPYYPYYPVQLTWNNGVAFYSNNAKGDGKDKPNDPIIEKSEPIDLDIKSEPPVEKHELTGTIEESNDSKPIDFEYHTAVEGAEGHAEGIIETEEDSIHVDFEESTHENSKHHADVVEYEEDTNPGGGQVTTESNLVEFDEESTKGIVTGAVSDHTTVEDTKEYTTESNLIELVDELP

SEQ ID NO: 41446 - protein, 438 aa, Staphylococcus aureus
  subsp. aureus VRS6
EDSIHVDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTLEVPSEPETPTPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 41447 - protein, 576 aa, Staphylococcus aureus
  subsp. aureus VRS6
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVRKRRNSFEKERKFNPDLAPG

SEQ ID NO: 41448 - protein, 396 aa, Staphylococcus aureus
  subsp. aureus VRS6
NSKHHADVVEYEEDTNPGGGQVTTESNLVEFDEESTKGIVTGAVSDHTTVEDTKEYTTESNLIELVDELPEEHGQAQGPIEEITENNHHISHSGLGTENGHGNYGVIDEIEENSHVDIKSELGYEGGQNSGNQSFEEDTEEDKPKYEQGGNIVDIDFDSVPQIHGQNNGNQSFEEDTEEDKPKYEQGGNIIDIDFDSVPQIHGFNKHNEIIEEDTNKDKPNYQFGGHNSVDFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGKVVTPVIEINEKVKAVAPTKQKQSKKSELPETGGEESTNKGMLFGGLFSILGLVLLRRNKKNNKA

SEQ ID NO: 41449 - protein, 321 aa, Staphylococcus aureus; identical to SEQ ID NO: 30959
  subsp. aureus VRS6

SEQ ID NO: 41450 - protein, 315 aa, Staphylococcus aureus; identical to SEQ ID NO: 30573
  subsp. aureus VRS6

SEQ ID NO: 41451 - protein, 325 aa, Staphylococcus aureus; identical to SEQ ID NO: 30407
  subsp. aureus VRS6

SEQ ID NO: 41452 - protein, 383 aa, Staphylococcus aureus
  subsp. aureus VRS6
MSKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 41453 - protein, 809 aa, Staphylococcus aureus; identical to SEQ ID NO: 30632
  subsp. aureus VRS6

SEQ ID NO: 41454 - protein, 141 aa, Staphylococcus aureus; identical to SEQ ID NO: 30633
  subsp. aureus VRS6

SEQ ID NO: 41455 - protein, 2481 aa, Staphylococcus aureus; identical to SEQ ID NO: 30631
  subsp. aureus VRS6

SEQ ID NO: 41456 - protein, 231 aa, Staphylococcus aureus; identical to SEQ ID NO: 30630
  subsp. aureus VRS6

SEQ ID NO: 41457 - protein, 44 aa, Staphylococcus aureus; identical to SEQ ID NO: 30513
  subsp. aureus VRS6

SEQ ID NO: 41458 - protein, 274 aa, Staphylococcus aureus; identical to SEQ ID NO: 30815
  subsp. aureus VRS6

SEQ ID NO: 41459 - protein, 338 aa, Staphylococcus aureus; identical to SEQ ID NO: 30627
  subsp. aureus VRS6

SEQ ID NO: 41460 - protein, 351 aa, Staphylococcus aureus; identical to SEQ ID NO: 30628
  subsp. aureus VRS6

SEQ ID NO: 41461 - protein, 96 aa, Staphylococcus aureus; identical to SEQ ID NO: 30813
  subsp. aureus VRS6

SEQ ID NO: 41462 - protein, 327 aa, Staphylococcus aureus; identical to SEQ ID NO: 30616
  subsp. aureus VRS6

SEQ ID NO: 41463 - protein, 311 aa, Staphylococcus aureus; identical to SEQ ID NO: 30617
  subsp. aureus VRS6

SEQ ID NO: 41464 - protein, 258 aa, Staphylococcus aureus; identical to SEQ ID NO: 30410
  subsp. aureus VRS6

SEQ ID NO: 41465 - protein, 251 aa, Staphylococcus aureus; identical to SEQ ID NO: 30946
  subsp. aureus VRS6

SEQ ID NO: 41466 - protein, 131 aa, Staphylococcus aureus; identical to SEQ ID NO: 40897
  subsp. aureus VRS6

SEQ ID NO: 41467 - protein, 242 aa, Staphylococcus aureus; identical to SEQ ID NO: 30399
  subsp. aureus VRS6

SEQ ID NO: 41468 - protein, 239 aa, Staphylococcus aureus; identical to SEQ ID NO: 30622
  subsp. aureus VRS6

SEQ ID NO: 41469 - protein, 254 aa, Staphylococcus aureus; identical to SEQ ID NO: 30809
  subsp. aureus VRS6

SEQ ID NO: 41470 - protein, 331 aa, Staphylococcus aureus; identical to SEQ ID NO: 30615
  subsp. aureus VRS6

SEQ ID NO: 41471 - protein, 891 aa, Staphylococcus aureus; identical to SEQ ID NO: 30788
  subsp. aureus VRS6

SEQ ID NO: 41472 - protein, 2186 aa, Staphylococcus aureus; identical to SEQ ID NO: 30789
  subsp. aureus VRS6

SEQ ID NO: 41473 - protein, 291 aa, Staphylococcus aureus; identical to SEQ ID NO: 33009
  subsp. aureus VRS6

SEQ ID NO: 41474 - protein, 62 aa, Staphylococcus aureus; identical to SEQ ID NO: 30610
  subsp. aureus VRS6

SEQ ID NO: 41475 - protein, 157 aa, Staphylococcus aureus; identical to SEQ ID NO: 30611
  subsp. aureus VRS6

SEQ ID NO: 41476 - protein, 372 aa, Staphylococcus aureus; identical to SEQ ID NO: 30609
  subsp. aureus VRS6

SEQ ID NO: 41477 - protein, 319 aa, Staphylococcus aureus; identical to SEQ ID NO: 30605
  subsp. aureus VRS6

SEQ ID NO: 41478 - protein, 238 aa, Staphylococcus aureus; identical to SEQ ID NO: 30606
  subsp. aureus VRS6

SEQ ID NO: 41479 - protein, 241 aa, Staphylococcus aureus; identical to SEQ ID NO: 30607
  subsp. aureus VRS6

SEQ ID NO: 41480 - protein, 241 aa, Staphylococcus aureus; identical to SEQ ID NO: 30608
  subsp. aureus VRS6

SEQ ID NO: 41481 - protein, 645 aa, Staphylococcus aureus; identical to SEQ ID NO: 30601
  subsp. aureus VRS6

SEQ ID NO: 41482 - protein, 350 aa, Staphylococcus aureus; identical to SEQ ID NO: 30602
  subsp. aureus VRS6

SEQ ID NO: 41483 - protein, 109 aa, Staphylococcus aureus; identical to SEQ ID NO: 30603
  subsp. aureus VRS6

SEQ ID NO: 41484 - protein, 165 aa, Staphylococcus aureus; identical to SEQ ID NO: 30418
  subsp. aureus VRS6

SEQ ID NO: 41485 - protein, 273 aa, Staphylococcus aureus
  subsp. aureus VRS6
SDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSESDSDSDSDSDSESDSDSDSDSDSDSDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41486 - protein, 434 aa, Staphylococcus aureus [sequence omitted]

SEQ ID NO: 41487 - protein, 261 aa, Staphylococcus aureus
  subsp. aureus VRS6
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVLTIV

SEQ ID NO: 41488 - protein, 99 aa, Staphylococcus aureus
  subsp. aureus VRS6
DSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 41489 - protein, 98 aa, Staphylococcus aureus
  subsp. aureus VRS6
SDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 41490 - protein, 968 aa, Staphylococcus aureus
  subsp. aureus VRS6
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDS

SEQ ID NO: 41491 - protein, 99 aa, Staphylococcus aureus
  subsp. aureus VRS6
DSDSDSDSDSDSDSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 41492 - protein, 1075 aa, Staphylococcus aureus; identical to SEQ ID NO: 40922
  subsp. aureus VRS6

SEQ ID NO: 41493 - protein, 735 aa, Staphylococcus aureus
  subsp. aureus VRS6
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSD

SEQ ID NO: 41494 - protein, 176 aa, Staphylococcus aureus
  subsp. aureus VRS6
KIVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 41495 - protein, 231 aa, Staphylococcus aureus; identical to SEQ ID NO: 30582
  subsp. aureus VRS6

SEQ ID NO: 41496 - protein, 232 aa, Staphylococcus aureus; identical to SEQ ID NO: 30583
  subsp. aureus VRS6

SEQ ID NO: 41497 - protein, 232 aa, Staphylococcus aureus; identical to SEQ ID NO: 30584
  subsp. aureus VRS6

SEQ ID NO: 41498 - protein, 227 aa, Staphylococcus aureus; identical to SEQ ID NO: 30585
  subsp. aureus VRS6

SEQ ID NO: 41499 - protein, 227 aa, Staphylococcus aureus; identical to SEQ ID NO: 30586
  subsp. aureus VRS6

SEQ ID NO: 41500 - protein, 691 aa, Staphylococcus aureus; identical to SEQ ID NO: 30511
  subsp. aureus VRS6

SEQ ID NO: 41501 - protein, 203 aa, Staphylococcus aureus; identical to SEQ ID NO: 30576
  subsp. aureus VRS6

SEQ ID NO: 41502 - protein, 226 aa, Staphylococcus aureus; identical to SEQ ID NO: 30577
  subsp. aureus VRS6

SEQ ID NO: 41503 - protein, 231 aa, Staphylococcus aureus; identical to SEQ ID NO: 30578
  subsp. aureus VRS6

SEQ ID NO: 41504 - protein, 356 aa, Staphylococcus aureus; identical to SEQ ID NO: 40929
  subsp. aureus VRS6

SEQ ID NO: 41505 - protein, 292 aa, Staphylococcus aureus; identical to SEQ ID NO: 30580
  subsp. aureus VRS6

SEQ ID NO: 41506 - protein, 162 aa, Staphylococcus aureus
  subsp. aureus VRS6
MKMAAIAKASLALGILATGTITSLHQTVNASEHEAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYK

SEQ ID NO: 41507 - protein, 182 aa, Staphylococcus aureus
  subsp. aureus VRS6
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEIL

SEQ ID NO: 41508 - protein, 241 aa, Staphylococcus aureus; identical to SEQ ID NO: 30571
  subsp. aureus VRS6

SEQ ID NO: 41509 - protein, 197 aa, Staphylococcus aureus
  subsp. aureus VRS6
NAFYEILHLPNLTEEQRNGFIQSLKDDPSVSKEILAEAKKLNDAQAPKEEDNKKPGKEDGNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41510 - protein, 237 aa, Staphylococcus aureus
  subsp. aureus VRS7
MKKIALLTLFSTALLVSAPLVSFADEATGSSGVNVLADDVVDPVEPTDPTTPVDPVDPVDPVDPVDPVDPTEPTEPTEPTEPTEPTEPTEPTEPTEPTEPTEPTEPTEPTEPTEPTEPTEPSKPTEPTEPSKPTEPTEPSKPVDTNPIENPVNTDTGVVIVAVEDSKPIIQLADGTTKKVEAKEIGANVQKDGTVTVKGTDGKMKVLPKTGETTNVALSVLGSFMVLVSGLIFKKRI

SEQ ID NO: 41511 - protein, 712 aa, Staphylococcus aureus
  subsp. aureus VRS7
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDS

SEQ ID NO: 41512 - protein, 2271 aa, Staphylococcus aureus; identical to SEQ ID NO: 30597
  subsp. aureus VRS7

SEQ ID NO: 41513 - protein, 681 aa, Staphylococcus aureus; identical to SEQ ID NO: 30598
  subsp. aureus VRS7

SEQ ID NO: 41514 - protein, 211 aa, Staphylococcus aureus; identical to SEQ ID NO: 30592
  subsp. aureus VRS7

SEQ ID NO: 41515 - protein, 154 aa, Staphylococcus aureus
  subsp. aureus VRS7
SDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 41516 - protein, 571 aa, Staphylococcus aureus
  subsp. aureus VRS7
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETIAPGHRDEFDPKLPTGEKEEVPGKPGIKNPETGDVVRPPVDSVTKYGPVKGDSIVEKKKFHSRKNVNLIL

SEQ ID NO: 41517 - protein, 961 aa, Staphylococcus aureus; identical to SEQ ID NO: 30589
  subsp. aureus VRS7

SEQ ID NO: 41518 - protein, 1038 aa, Staphylococcus aureus; identical to SEQ ID NO: 30590
  subsp. aureus VRS7

SEQ ID NO: 41519 - protein, 233 aa, Staphylococcus aureus; identical to SEQ ID NO: 30591
  subsp. aureus VRS7

SEQ ID NO: 41520 - protein, 321 aa, Staphylococcus aureus; identical to SEQ ID NO: 30959
  subsp. aureus VRS7

SEQ ID NO: 41521 - protein, 315 aa, Staphylococcus aureus; identical to SEQ ID NO: 30573
  subsp. aureus VRS7

SEQ ID NO: 41522 - protein, 325 aa, Staphylococcus aureus; identical to SEQ ID NO: 30407
  subsp. aureus VRS7

SEQ ID NO: 41523 - protein, 371 aa, Staphylococcus aureus
  subsp. aureus VRS7
DPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 41524 - protein, 809 aa, Staphylococcus aureus; identical to SEQ ID NO: 30632
  subsp. aureus VRS7

SEQ ID NO: 41525 - protein, 141 aa, Staphylococcus aureus; identical to SEQ ID NO: 30633
  subsp. aureus VRS7

SEQ ID NO: 41526 - protein, 231 aa, Staphylococcus aureus; identical to SEQ ID NO: 30630
  subsp. aureus VRS7

SEQ ID NO: 41527 - protein, 2481 aa, Staphylococcus aureus; identical to SEQ ID NO: 30631
  subsp. aureus VRS7

SEQ ID NO: 41528 - protein, 274 aa, Staphylococcus aureus; identical to SEQ ID NO: 30815
  subsp. aureus VRS7

SEQ ID NO: 41529 - protein, 338 aa, Staphylococcus aureus; identical to SEQ ID NO: 30627
  subsp. aureus VRS7

SEQ ID NO: 41530 - protein, 351 aa, Staphylococcus aureus; identical to SEQ ID NO: 30628
  subsp. aureus VRS7

SEQ ID NO: 41531 - protein, 44 aa, Staphylococcus aureus; identical to SEQ ID NO: 30513
  subsp. aureus VRS7

SEQ ID NO: 41532 - protein, 96 aa, Staphylococcus aureus; identical to SEQ ID NO: 30813
  subsp. aureus VRS7

SEQ ID NO: 41533 - protein, 891 aa, Staphylococcus aureus; identical to SEQ ID NO: 30788
  subsp. aureus VRS7

SEQ ID NO: 41534 - protein, 2186 aa, Staphylococcus aureus; identical to SEQ ID NO: 41400
  subsp. aureus VRS7

SEQ ID NO: 41535 - protein, 331 aa, Staphylococcus aureus; identical to SEQ ID NO: 30615
  subsp. aureus VRS7

SEQ ID NO: 41536 - protein, 327 aa, Staphylococcus aureus; identical to SEQ ID NO: 30616
  subsp. aureus VRS7

SEQ ID NO: 41537 - protein, 311 aa, Staphylococcus aureus; identical to SEQ ID NO: 30617
  subsp. aureus VRS7

SEQ ID NO: 41538 - protein, 258 aa, Staphylococcus aureus; identical to SEQ ID NO: 30410
  subsp. aureus VRS7

SEQ ID NO: 41539 - protein, 251 aa, Staphylococcus aureus; identical to SEQ ID NO: 30946
  subsp. aureus VRS7

SEQ ID NO: 41540 - protein, 131 aa, Staphylococcus aureus; identical to SEQ ID NO: 30867
  subsp. aureus VRS7

SEQ ID NO: 41541 - protein, 242 aa, Staphylococcus aureus; identical to SEQ ID NO: 30399
  subsp. aureus VRS7

SEQ ID NO: 41542 - protein, 239 aa, Staphylococcus aureus; identical to SEQ ID NO: 30622
  subsp. aureus VRS7

SEQ ID NO: 41543 - protein, 254 aa, Staphylococcus aureus; identical to SEQ ID NO: 30809
  subsp. aureus VRS7

SEQ ID NO: 41544 - protein, 62 aa, Staphylococcus aureus; identical to SEQ ID NO: 30610
  subsp. aureus VRS7

SEQ ID NO: 41545 - protein, 157 aa, Staphylococcus aureus; identical to SEQ ID NO: 30611
  subsp. aureus VRS7

SEQ ID NO: 41546 - protein, 291 aa, Staphylococcus aureus; identical to SEQ ID NO: 30390
  subsp. aureus VRS7

SEQ ID NO: 41547 - protein, 319 aa, Staphylococcus aureus; identical to SEQ ID NO: 30605
  subsp. aureus VRS7

SEQ ID NO: 41548 - protein, 238 aa, Staphylococcus aureus; identical to SEQ ID NO: 30606
  subsp. aureus VRS7

SEQ ID NO: 41549 - protein, 241 aa, Staphylococcus aureus; identical to SEQ ID NO: 30607
  subsp. aureus VRS7

SEQ ID NO: 41550 - protein, 241 aa, Staphylococcus aureus; identical to SEQ ID NO: 30608
  subsp. aureus VRS7

SEQ ID NO: 41551 - protein, 372 aa, Staphylococcus aureus; identical to SEQ ID NO: 30609
  subsp. aureus VRS7

SEQ ID NO: 41552 - protein, 645 aa, Staphylococcus aureus; identical to SEQ ID NO: 30601
  subsp. aureus VRS7

SEQ ID NO: 41553 - protein, 350 aa, Staphylococcus aureus; identical to SEQ ID NO: 30602
  subsp. aureus VRS7

SEQ ID NO: 41554 - protein, 82 aa, Staphylococcus aureus
  subsp. aureus VRS7
MHKLKTLKLLKKYDQYQTNFKKQVNKKVVDAQKAVNLFKRTRTVATHRKAQRAVNLIHFQHSYEKKKLQRQIDLVLKYNTLK

SEQ ID NO: 41555 - protein, 165 aa, Staphylococcus aureus; identical to SEQ ID NO: 30418
  subsp. aureus VRS7

SEQ ID NO: 41556 - protein, 302 aa, Staphylococcus aureus
  subsp. aureus VRS7
RFSSDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41557 - protein, 434 aa, Staphylococcus aureus [sequence omitted]

SEQ ID NO: 41558 - protein, 642 aa, Staphylococcus aureus
  subsp. aureus VRS7
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSA

SEQ ID NO: 41559 - protein, 136 aa, Staphylococcus aureus
  subsp. aureus VRS7
SDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 41560 - protein, 164 aa, Staphylococcus aureus
  subsp. aureus VRS7
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 41561 - protein, 1064 aa, Staphylococcus aureus
  subsp. aureus VRS7
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 41562 - protein, 965 aa, Staphylococcus aureus; identical to SEQ ID NO: 30920
  subsp. aureus VRS7

SEQ ID NO: 41563 - protein, 1186 aa, Staphylococcus aureus; identical to SEQ ID NO: 41063
  subsp. aureus VRS7

SEQ ID NO: 41564 - protein, 691 aa, Staphylococcus aureus; identical to SEQ ID NO: 30511
  subsp. aureus VRS7

SEQ ID NO: 41565 - protein, 203 aa, Staphylococcus aureus; identical to SEQ ID NO: 30576
  subsp. aureus VRS7

SEQ ID NO: 41566 - protein, 226 aa, Staphylococcus aureus; identical to SEQ ID NO: 30577
  subsp. aureus VRS7

SEQ ID NO: 41567 - protein, 231 aa, Staphylococcus aureus; identical to SEQ ID NO: 30578
  subsp. aureus VRS7

SEQ ID NO: 41568 - protein, 356 aa, Staphylococcus aureus; identical to SEQ ID NO: 30579
  subsp. aureus VRS7

SEQ ID NO: 41569 - protein, 292 aa, Staphylococcus aureus; identical to SEQ ID NO: 30580
  subsp. aureus VRS7

SEQ ID NO: 41570 - protein, 234 aa, Staphylococcus aureus; identical to SEQ ID NO: 30581
  subsp. aureus VRS7

SEQ ID NO: 41571 - protein, 231 aa, Staphylococcus aureus; identical to SEQ ID NO: 30582
  subsp. aureus VRS7

SEQ ID NO: 41572 - protein, 232 aa, Staphylococcus aureus; identical to SEQ ID NO: 30583
  subsp. aureus VRS7

SEQ ID NO: 41573 - protein, 232 aa, Staphylococcus aureus; identical to SEQ ID NO: 30584
  subsp. aureus VRS7

SEQ ID NO: 41574 - protein, 227 aa, Staphylococcus aureus; identical to SEQ ID NO: 30585
  subsp. aureus VRS7

SEQ ID NO: 41575 - protein, 227 aa, Staphylococcus aureus; identical to SEQ ID NO: 30586
  subsp. aureus VRS7

SEQ ID NO: 41576 - protein, 450 aa, Staphylococcus aureus
  subsp. aureus VRS7
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41577 - protein, 241 aa, Staphylococcus aureus; identical to SEQ ID NO: 30571
  subsp. aureus VRS7

SEQ ID NO: 41578 - protein, 644 aa, Staphylococcus aureus
  subsp. aureus VRS8
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDS

SEQ ID NO: 41579 - protein, 2271 aa, Staphylococcus aureus; identical to SEQ ID NO: 30597
  subsp. aureus VRS8

SEQ ID NO: 41580 - protein, 681 aa, Staphylococcus aureus; identical to SEQ ID NO: 30598
  subsp. aureus VRS8

SEQ ID NO: 41581 - protein, 321 aa, Staphylococcus aureus; identical to SEQ ID NO: 30959
  subsp. aureus VRS8

SEQ ID NO: 41582 - protein, 315 aa, Staphylococcus aureus; identical to SEQ ID NO: 30573
  subsp. aureus VRS8

SEQ ID NO: 41583 - protein, 325 aa, Staphylococcus aureus; identical to SEQ ID NO: 30407
  subsp. aureus VRS8

SEQ ID NO: 41584 - protein, 867 aa, Staphylococcus aureus
  subsp. aureus VRS8
MRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEASVKAEDISKKEDTPKEVANVAEVQPKSSVTHNAEAPKVRKARSVDEGSFDITRDSKNVVESTPITIQGKEHFEGYGSVDIQKNPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 41585 - protein, 961 aa, Staphylococcus aureus; identical to SEQ ID NO: 30589
  subsp. aureus VRS8

SEQ ID NO: 41586 - protein, 1010 aa, Staphylococcus aureus
  subsp. aureus VRS8
MKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANVETVKEEEKPQVKETTQPQDNSGNQRQVDLTPKKVTQNQGTETQVEVAQPRTASESKPRVTRSADVAEAKEASDVSEVKGTDVTSKVTVESGSIEAPQGNKVEPHAGQRVVLKYKLKFADGLKRGDYFDFTLSNNVNTYGVSTARKVPEIKNGSVVMATGEILGNGNIRYTFTNEIEHKVEVTANLEINLFIDPKTVQSNGEQKITSKLNGEETEKTIPVVYNPGVSNSYTNVNGSIETFNKESNKFTHIAYIKPMNGNQSNTVSVTGTLTEGSNLAGGQPTVKVYEYLGKKDELPQSVYANTSDTNKFKDVTKEMNGKLSVQDNGSYSLNLDKLDKTYVIHYTGEYLQGSDQVNFRTELYGYPERAYKSYYVYGGYRLTWDNGLVLYSNKADGNGKNGQIIQDNDFEYKEDTAKGTMSGQYDAKQIIETEENQDNTPLDIDYHTAIDGEGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNKGDQSFEEDTEKDKPKYEHGGNIIDIDFDSVPQIHGFNKHNEIIEEDTNKDKPNYQFGGHNSVDFEEDTLPKVSGQNEGQQTIEEDTTPPTPPTPEVPSEPETPMPPTPEVPSEPETPTPPTPEVPSEPETPTPPTPEVPAEPGKPVPPAKEEPKKPSKPVEQGKVVTPVIEINEKVKAVAPTKKAQSKKSELPETGGEESTNKGMLFGGLFSILGLALLRRNKKNNKA

SEQ ID NO: 41587 - protein, 233 aa, Staphylococcus aureus; identical to SEQ ID NO: 30591
  subsp. aureus VRS8

SEQ ID NO: 41588 - protein, 211 aa, Staphylococcus aureus; identical to SEQ ID NO: 30592
  subsp. aureus VRS8

SEQ ID NO: 41589 - protein, 145 aa, Staphylococcus aureus
  subsp. aureus VRS8
DSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 41590 - protein, 809 aa, Staphylococcus aureus; identical to SEQ ID NO: 30632
  subsp. aureus VRS8

SEQ ID NO: 41591 - protein, 141 aa, Staphylococcus aureus; identical to SEQ ID NO: 30633
  subsp. aureus VRS8

SEQ ID NO: 41592 - protein, 231 aa, Staphylococcus aureus; identical to SEQ ID NO: 30630
  subsp. aureus VRS8

SEQ ID NO: 41593 - protein, 2481 aa, Staphylococcus aureus; identical to SEQ ID NO: 36685
  subsp. aureus VRS8

SEQ ID NO: 41594 - protein, 96 aa, Staphylococcus aureus; identical to SEQ ID NO: 30813
  subsp. aureus VRS8

SEQ ID NO: 41595 - protein, 344 aa, Staphylococcus aureus
  subsp. aureus VRS8
MHLFCCKLYKRSDNDGKKTKSNSLKKVATLALANLLLVGALTDNSAKAESKKDDTDLKLVSHNVYMLSTVLYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNIHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKQLVNEVVTEKPKPWDVYAFPYYYVYNDFSDHYPIKAYSK

SEQ ID NO: 41596 - protein, 338 aa, Staphylococcus aureus
  subsp. aureus VRS8
MIKQLYKNITICSLAISTALTVFPATSYAKINSEIKAVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNIIKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHDVKFVKVLNDNEKK

SEQ ID NO: 41597 - protein, 351 aa, Staphylococcus aureus; identical to SEQ ID NO: 30628
  subsp. aureus VRS8

SEQ ID NO: 41598 - protein, 44 aa, Staphylococcus aureus; identical to SEQ ID NO: 30513
  subsp. aureus VRS8

SEQ ID NO: 41599 - protein, 2186 aa, Staphylococcus aureus
  subsp. aureus VRS8
MNLLKKNKYSIRKYKVGIFSTLIGTVLLLSNPNGAQALTTDNNVQSDTNQATPVNSQDTNVANNRGLANSAQNTPNQSATTNQSTNQALVNHNNGSIANQATPTSVQSSTPSAQNNNHTDGNTTATETVSNANNKDVVSNNTTLNVPNKTNENGSGGHLTLKEIQEDVRHSSDKPELVAIAEQASNRPKKRSRRAAPADPNATPADPAAAAAGNGGAPVAITAPYTPTTDPNANNAGQNAPNEVLSFDDNGIRPSTNRSVPSVTVVDNLPGFTLINGGKVGVFSHAMVRTSMFDSGDAKNYQAQGNVIALGRIKGNDTNDHGDFNGIEKSLTVNPNSELIFEFNTMTTKNYQGVTNLIIKNADNDTVIAEKSVAYGPIWRLFKVPENVSHLKIQFVPKNDAITDARGIYQLRDGYKYYDFVDSIGLHSGSHVYVERRTMEPTATNNKEFTVTTSLKNNGNFGASFNTDDFVYKVQLPEGVEYVNNSLTKDFPSSNSGVDMNDFNVTYDAANRVITIKSTGGGSGNSPARLMPDKILDLKYKLRVNNVPTPRTVTFNDTLTYKTYTQDFINSPAESHTVSTNPYTIDIIMNKDALQAEVDRRIQQADYTFASLDIFNDLKRRAQTILDENRNNVPLNKRVSQADIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVEIAKNNGINTIGAVVPQVTHKQAARDAINQATATKRQQINSNREATQEEKNAALNELTQATNHALEQINQATTNADVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDARNAVNDKAREAITNINATPGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKPTAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVAPEHIVRAAARDAVKQQYEAKKQEIEQAEHATDEEKQVALNQLANNEKLALQNINQAVTNNDVKRVETNGIATLKGVQPHIVIKPEAQQAIKATAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETVGNDNIKVILPKVQVKPAARQSVGVKAEAQNALIDQSDLSTEEERLAAKHLVEQALNQAIDQINHADKTAQVNQDSIDAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 41600 - protein, 331 aa, Staphylococcus aureus; identical to SEQ ID NO: 30615
  subsp. aureus VRS8

SEQ ID NO: 41601 - protein, 327 aa, Staphylococcus aureus; identical to SEQ ID NO: 30616
  subsp. aureus VRS8

SEQ ID NO: 41602 - protein, 311 aa, Staphylococcus aureus; identical to SEQ ID NO: 30617
  subsp. aureus VRS8

SEQ ID NO: 41603 - protein, 258 aa, Staphylococcus aureus; identical to SEQ ID NO: 30410
  subsp. aureus VRS8

SEQ ID NO: 41604 - protein, 251 aa, Staphylococcus aureus; identical to SEQ ID NO: 30946
  subsp. aureus VRS8

SEQ ID NO: 41605 - protein, 131 aa, Staphylococcus aureus; identical to SEQ ID NO: 30867
  subsp. aureus VRS8

SEQ ID NO: 41606 - protein, 242 aa, Staphylococcus aureus; identical to SEQ ID NO: 30399
  subsp. aureus VRS8

SEQ ID NO: 41607 - protein, 239 aa, Staphylococcus aureus; identical to SEQ ID NO: 30622
  subsp. aureus VRS8

SEQ ID NO: 41608 - protein, 254 aa, Staphylococcus aureus; identical to SEQ ID NO: 30809
  subsp. aureus VRS8

SEQ ID NO: 41609 - protein, 891 aa, Staphylococcus aureus; identical to SEQ ID NO: 30788
  subsp. aureus VRS8

SEQ ID NO: 41610 - protein, 62 aa, Staphylococcus aureus; identical to SEQ ID NO: 30610
  subsp. aureus VRS8

SEQ ID NO: 41611 - protein, 157 aa, Staphylococcus aureus; identical to SEQ ID NO: 30611
  subsp. aureus VRS8

SEQ ID NO: 41612 - protein, 291 aa, Staphylococcus aureus; identical to SEQ ID NO: 30390
  subsp. aureus VRS8

SEQ ID NO: 41613 - protein, 319 aa, Staphylococcus aureus; identical to SEQ ID NO: 30605
  subsp. aureus VRS8

SEQ ID NO: 41614 - protein, 238 aa, Staphylococcus aureus; identical to SEQ ID NO: 30606
  subsp. aureus VRS8

SEQ ID NO: 41615 - protein, 241 aa, Staphylococcus aureus; identical to SEQ ID NO: 30607
  subsp. aureus VRS8

SEQ ID NO: 41616 - protein, 241 aa, Staphylococcus aureus; identical to SEQ ID NO: 30608
  subsp. aureus VRS8

SEQ ID NO: 41617 - protein, 372 aa, Staphylococcus aureus; identical to SEQ ID NO: 30609
  subsp. aureus VRS8

SEQ ID NO: 41618 - protein, 109 aa, Staphylococcus aureus; identical to SEQ ID NO: 30603
  subsp. aureus VRS8

SEQ ID NO: 41619 - protein, 165 aa, Staphylococcus aureus; identical to SEQ ID NO: 30418
  subsp. aureus VRS8

SEQ ID NO: 41620 - protein, 645 aa, Staphylococcus aureus; identical to SEQ ID NO: 30601
  subsp. aureus VRS8

SEQ ID NO: 41621 - protein, 350 aa, Staphylococcus aureus; identical to SEQ ID NO: 30602
  subsp. aureus VRS8

SEQ ID NO: 41622 - protein, 248 aa, Staphylococcus aureus
  subsp. aureus VRS8
DSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41623 - protein, 434 aa, Staphylococcus aureus [sequence omitted]

SEQ ID NO: 41624 - protein, 655 aa, Staphylococcus aureus
  subsp. aureus VRS8
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSAA

SEQ ID NO: 41625 - protein, 85 aa, Staphylococcus aureus
  subsp. aureus VRS8
DSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 41626 - protein, 134 aa, Staphylococcus aureus
  subsp. aureus VRS8
SDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 41627 - protein, 990 aa, Staphylococcus aureus
  subsp. aureus VRS8
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDS

SEQ ID NO: 41628 - protein, 87 aa, Staphylococcus aureus
  subsp. aureus VRS8
DSDSDSDSDSDSDSDSDSDSDSDSDSDAGKHTPTKPMSTVKDQHKTAKALPETGSENNNSNNGTLFGGLFAALGSLLLFGRRKKQNK

SEQ ID NO: 41629 - protein, 1182 aa, Staphylococcus aureus
  subsp. aureus VRS8
  MOD_RES (1173)..(1173): Any amino acid
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSXSDQTQIAIR

SEQ ID NO: 41630 - protein, 773 aa, Staphylococcus aureus
  subsp. aureus VRS8
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSE

SEQ ID NO: 41631 - protein, 203 aa, Staphylococcus aureus; identical to SEQ ID NO: 30576
  subsp. aureus VRS8

SEQ ID NO: 41632 - protein, 226 aa, Staphylococcus aureus; identical to SEQ ID NO: 30577
  subsp. aureus VRS8

SEQ ID NO: 41633 - protein, 231 aa, Staphylococcus aureus; identical to SEQ ID NO: 30578
  subsp. aureus VRS8

SEQ ID NO: 41634 - protein, 356 aa, Staphylococcus aureus; identical to SEQ ID NO: 30579
  subsp. aureus VRS8

SEQ ID NO: 41635 - protein, 292 aa, Staphylococcus aureus; identical to SEQ ID NO: 30580
  subsp. aureus VRS8

SEQ ID NO: 41636 - protein, 234 aa, Staphylococcus aureus; identical to SEQ ID NO: 30581
  subsp. aureus VRS8

SEQ ID NO: 41637 - protein, 231 aa, Staphylococcus aureus; identical to SEQ ID NO: 30582
  subsp. aureus VRS8

SEQ ID NO: 41638 - protein, 232 aa, Staphylococcus aureus; identical to SEQ ID NO: 30583
  subsp. aureus VRS8

SEQ ID NO: 41639 - protein, 232 aa, Staphylococcus aureus; identical to SEQ ID NO: 30584
  subsp. aureus VRS8

SEQ ID NO: 41640 - protein, 227 aa, Staphylococcus aureus; identical to SEQ ID NO: 30585
  subsp. aureus VRS8

SEQ ID NO: 41641 - protein, 227 aa, Staphylococcus aureus; identical to SEQ ID NO: 30586
  subsp. aureus VRS8

SEQ ID NO: 41642 - protein, 645 aa, Staphylococcus aureus; identical to SEQ ID NO: 30908
  subsp. aureus VRS8

SEQ ID NO: 41643 - protein, 200 aa, Staphylococcus aureus
  subsp. aureus VRS8
MSKEILAEAKKLNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41644 - protein, 215 aa, Staphylococcus aureus
  subsp. aureus VRS8
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKS

SEQ ID NO: 41645 - protein, 241 aa, Staphylococcus aureus; identical to SEQ ID NO: 30571
  subsp. aureus VRS8

SEQ ID NO: 41646 - protein, 739 aa, Staphylococcus aureus
  subsp. aureus VRS9
MKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSD

SEQ ID NO: 41647 - protein, 2269 aa, Staphylococcus aureus; identical to SEQ ID NO: 40940
  subsp. aureus VRS9

SEQ ID NO: 41648 - protein, 681 aa, Staphylococcus aureus; identical to SEQ ID NO: 30598
  subsp. aureus VRS9

SEQ ID NO: 41649 - protein, 809 aa, Staphylococcus aureus; identical to SEQ ID NO: 30632
  subsp. aureus VRS9

SEQ ID NO: 41650 - protein, 141 aa, Staphylococcus aureus; identical to SEQ ID NO: 30633
  subsp. aureus VRS9

SEQ ID NO: 41651 - protein, 321 aa, Staphylococcus aureus; identical to SEQ ID NO: 30959
  subsp. aureus VRS9

SEQ ID NO: 41652 - protein, 315 aa, Staphylococcus aureus; identical to SEQ ID NO: 30573
  subsp. aureus VRS9

SEQ ID NO: 41653 - protein, 325 aa, Staphylococcus aureus; identical to SEQ ID NO: 30407
  subsp. aureus VRS9

SEQ ID NO: 41654 - protein, 859 aa, Staphylococcus aureus; identical to SEQ ID NO: 40945
  subsp. aureus VRS9

SEQ ID NO: 41655 - protein, 961 aa, Staphylococcus aureus; identical to SEQ ID NO: 30589
  subsp. aureus VRS9

SEQ ID NO: 41656 - protein, 1038 aa, Staphylococcus aureus; identical to SEQ ID NO: 30590
  subsp. aureus VRS9

SEQ ID NO: 41657 - protein, 233 aa, Staphylococcus aureus; identical to SEQ ID NO: 30591
  subsp. aureus VRS9

SEQ ID NO: 41658 - protein, 211 aa, Staphylococcus aureus; identical to SEQ ID NO: 30592
  subsp. aureus VRS9

SEQ ID NO: 41659 - protein, 131 aa, Staphylococcus aureus
  subsp. aureus VRS9
DSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 41660 - protein, 2481 aa, Staphylococcus aureus; identical to SEQ ID NO: 30631
  subsp. aureus VRS9

SEQ ID NO: 41661 - protein, 231 aa, Staphylococcus aureus; identical to SEQ ID NO: 30630
  subsp. aureus VRS9

SEQ ID NO: 41662 - protein, 96 aa, Staphylococcus aureus; identical to SEQ ID NO: 30813
  subsp. aureus VRS9

SEQ ID NO: 41663 - protein, 274 aa, Staphylococcus aureus; identical to SEQ ID NO: 30815
  subsp. aureus VRS9

SEQ ID NO: 41664 - protein, 338 aa, Staphylococcus aureus; identical to SEQ ID NO: 40957
  subsp. aureus VRS9

SEQ ID NO: 41665 - protein, 351 aa, Staphylococcus aureus; identical to SEQ ID NO: 30628
  subsp. aureus VRS9

SEQ ID NO: 41666 - protein, 44 aa, Staphylococcus aureus; identical to SEQ ID NO: 30513
  subsp. aureus VRS9

SEQ ID NO: 41667 - protein, 331 aa, Staphylococcus aureus; identical to SEQ ID NO: 30615
  subsp. aureus VRS9

SEQ ID NO: 41668 - protein, 327 aa, Staphylococcus aureus; identical to SEQ ID NO: 30616
  subsp. aureus VRS9

SEQ ID NO: 41669 - protein, 311 aa, Staphylococcus aureus; identical to SEQ ID NO: 30617
  subsp. aureus VRS9

SEQ ID NO: 41670 - protein, 258 aa, Staphylococcus aureus; identical to SEQ ID NO: 30410
  subsp. aureus VRS9

SEQ ID NO: 41671 - protein, 251 aa, Staphylococcus aureus; identical to SEQ ID NO: 30946
  subsp. aureus VRS9

SEQ ID NO: 41672 - protein, 131 aa, Staphylococcus aureus; identical to SEQ ID NO: 30867
  subsp. aureus VRS9

SEQ ID NO: 41673 - protein, 242 aa, Staphylococcus aureus; identical to SEQ ID NO: 30399
  subsp. aureus VRS9

SEQ ID NO: 41674 - protein, 239 aa, Staphylococcus aureus; identical to SEQ ID NO: 30622
  subsp. aureus VRS9

SEQ ID NO: 41675 - protein, 254 aa, Staphylococcus aureus; identical to SEQ ID NO: 30809
  subsp. aureus VRS9

SEQ ID NO: 41676 - protein, 2186 aa, Staphylococcus aureus; identical to SEQ ID NO: 30789
  subsp. aureus VRS9

SEQ ID NO: 41677 - protein, 891 aa, Staphylococcus aureus; identical to SEQ ID NO: 30788
  subsp. aureus VRS9

SEQ ID NO: 41678 - protein, 291 aa, Staphylococcus aureus; identical to SEQ ID NO: 33009
  subsp. aureus VRS9

SEQ ID NO: 41679 - protein, 62 aa, Staphylococcus aureus; identical to SEQ ID NO: 30610
  subsp. aureus VRS9

SEQ ID NO: 41680 - protein, 157 aa, Staphylococcus aureus; identical to SEQ ID NO: 30611
  subsp. aureus VRS9

SEQ ID NO: 41681 - protein, 319 aa, Staphylococcus aureus; identical to SEQ ID NO: 30605
  subsp. aureus VRS9

SEQ ID NO: 41682 - protein, 238 aa, Staphylococcus aureus; identical to SEQ ID NO: 30606
  subsp. aureus VRS9

SEQ ID NO: 41683 - protein, 241 aa, Staphylococcus aureus; identical to SEQ ID NO: 30607
  subsp. aureus VRS9

SEQ ID NO: 41684 - protein, 241 aa, Staphylococcus aureus; identical to SEQ ID NO: 30608
  subsp. aureus VRS9

SEQ ID NO: 41685 - protein, 372 aa, Staphylococcus aureus; identical to SEQ ID NO: 30609
  subsp. aureus VRS9

SEQ ID NO: 41686 - protein, 645 aa, Staphylococcus aureus; identical to SEQ ID NO: 30601
  subsp. aureus VRS9

SEQ ID NO: 41687 - protein, 350 aa, Staphylococcus aureus; identical to SEQ ID NO: 30602
  subsp. aureus VRS9

SEQ ID NO: 41688 - protein, 109 aa, Staphylococcus aureus; identical to SEQ ID NO: 30603
  subsp. aureus VRS9

SEQ ID NO: 41689 - protein, 138 aa, Staphylococcus aureus; identical to SEQ ID NO: 40984
  subsp. aureus VRS9

SEQ ID NO: 41690 - protein, 247 aa, Staphylococcus aureus
  subsp. aureus VRS9
SASDSDSASDSDSASDSDSASDSDSASDSDSASDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANTSLIWGLLASLGSLLLFRRKKENKDKK

SEQ ID NO: 41691 - protein, 434 aa, Staphylococcus aureus [sequence omitted]

SEQ ID NO: 41692 - protein, 701 aa, Staphylococcus aureus
  subsp. aureus VRS9
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRMRAFSLAAVAADAPAAGTDITNQLTDVKVTIDSGTTVYPHQAGYVKLNYGFSVPNSAVKGDTFKITVPKELNLNGVTSTAKVPPIMAGDQVLANGVIDSDGNVIYTFTDYVDNKENVTANITMPAYIDPENVTKTGNVTLTTGIGTNTASKTVLIDYEKYGQFHNLSIKGTIDQIDKTNNTYRQTIYVNPSGDNVVLPALTGNLIPNTKSNALIDAKNTDIKVYRVDNANDLSESYYVNPSDFEDVTNQVRISFPNANQYKVEFPTDDDQITTPYIVVVNGHIDPASTGDLALRSTFYGYDSNFIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSDSDSDSDSDSDSDSDSDSDSDSDSDSDSDSDSDSDSASDSDSDSDSES

SEQ ID NO: 41693 - protein, 84 aa, Staphylococcus aureus
  subsp. aureus VRS9
QRSDSDSDSDSDSDSDSDSDSDSDAGKHTPVKPMSTTKDHHNKAKALPETGSENNGSNNATLFGGLFAALGSLLLFGRRKKQNK

SEQ ID NO: 41694 - protein, 144 aa, Staphylococcus aureus
  subsp. aureus VRS9
SDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 41695 - protein, 980 aa, Staphylococcus aureus
  subsp. aureus VRS9
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKESTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDS

SEQ ID NO: 41696 - protein, 96 aa, Staphylococcus aureus; identical to SEQ ID NO: 32911
  subsp. aureus VRS9

SEQ ID NO: 41697 - protein, 1162 aa, Staphylococcus aureus
  subsp. aureus VRS9
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDS

SEQ ID NO: 41698 - protein, 746 aa, Staphylococcus aureus
  subsp. aureus VRS9
MNNKKTATNRKGMIPNRLNKFSIRKYSVGTASILVGTTLIFGLSGHEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQRALNRMAVNTVAAPQQGTNVNDKVHFTNIDIAIDKGHVNKTTGNTEFWATSSDVLKLKANYTIDDSVKEGDTFTFKYGQYFRPGSVRLPSQTQNLYNAQGNIIAKGIYDSKTNTTTYTFTNYVDQYTNVSGSFEQVAFAKRENATTDKTAYKMEVTLGNDTYSKDVIVDYGNQKGQQLISSTNYINNEDLSRNMTVYVNQPKKTYTKETFVTNLTGYKFNPDAKNFKIYEVTDQNQFVDSFTPDTSKLKDVTGQFDVIYSNDNKTATVDLLNGQSSSDKQYIIQQVAYPDNSSTDNGKIDYTLETQNGKSSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDS

SEQ ID NO: 41699 - protein, 691 aa, Staphylococcus aureus
  subsp. aureus VRS9
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVKKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFINVTNDEPATRRGIWQVKPIIQGWDHVDFIGVDFLDFKRKGAELANFYTGIINDLLRVEATESKGTQLKAS

SEQ ID NO: 41700 - protein, 203 aa, Staphylococcus aureus; identical to SEQ ID NO: 30576
  subsp. aureus VRS9

SEQ ID NO: 41701 - protein, 226 aa, Staphylococcus aureus; identical to SEQ ID NO: 30577
  subsp. aureus VRS9

SEQ ID NO: 41702 - protein, 231 aa, Staphylococcus aureus; identical to SEQ ID NO: 30578
  subsp. aureus VRS9

SEQ ID NO: 41703 - protein, 356 aa, Staphylococcus aureus; identical to SEQ ID NO: 30793
  subsp. aureus VRS9

SEQ ID NO: 41704 - protein, 292 aa, Staphylococcus aureus; identical to SEQ ID NO: 30580
  subsp. aureus VRS9

SEQ ID NO: 41705 - protein, 234 aa, Staphylococcus aureus; identical to SEQ ID NO: 30581
  subsp. aureus VRS9

SEQ ID NO: 41706 - protein, 231 aa, Staphylococcus aureus; identical to SEQ ID NO: 30582
  subsp. aureus VRS9

SEQ ID NO: 41707 - protein, 232 aa, Staphylococcus aureus; identical to SEQ ID NO: 30583
  subsp. aureus VRS9

SEQ ID NO: 41708 - protein, 232 aa, Staphylococcus aureus; identical to SEQ ID NO: 30584
  subsp. aureus VRS9

SEQ ID NO: 41709 - protein, 227 aa, Staphylococcus aureus; identical to SEQ ID NO: 30585
  subsp. aureus VRS9

SEQ ID NO: 41710 - protein, 227 aa, Staphylococcus aureus; identical to SEQ ID NO: 30586
  subsp. aureus VRS9

SEQ ID NO: 41711 - protein, 226 aa, Staphylococcus aureus
  subsp. aureus VRS9
MKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYE

SEQ ID NO: 41712 - protein, 241 aa, Staphylococcus aureus; identical to SEQ ID NO: 30571
  subsp. aureus VRS9

SEQ ID NO: 41713 - protein, 254 aa, Staphylococcus aureus
  subsp. aureus VRS9
PNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDGKKPGKEDGNKPGKEDNNKPGKEDGNKPGKEDNNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41714 - protein, 791 aa, Staphylococcus aureus
  subsp. aureus WBG10049
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDVYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSESDSDS

SEQ ID NO: 41715 - protein, 54 aa, Staphylococcus aureus; identical to SEQ ID NO: 35777
  subsp. aureus WBG10049

SEQ ID NO: 41716 - protein, 787 aa, Staphylococcus aureus
  subsp. aureus WBG10049
MLNRENKTSMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLG

SEQ ID NO: 41717 - protein, 395 aa, Staphylococcus aureus
  subsp. aureus WBG10049
GVQDKDEKGISGVTVTLKDENDKVLKTVTTDENGKYQFTDLNNGTYKVEFETPSGYTPTSVTTGNDTEKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSESDSDSDSESDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 41718 - protein, 1149 aa, Staphylococcus aureus; identical to SEQ ID NO: 30443
  subsp. aureus WBG10049

SEQ ID NO: 41719 - protein, 434 aa, Staphylococcus aureus [sequence omitted]

SEQ ID NO: 41720 - protein, 993 aa, Staphylococcus aureus
  subsp. aureus WBG10049
MNMKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSTSDSDSTSDSDSASDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 41721 - protein, 648 aa, Staphylococcus aureus; identical to SEQ ID NO: 31909
  subsp. aureus WBG10049

SEQ ID NO: 41722 - protein, 354 aa, Staphylococcus aureus; identical to SEQ ID NO: 31908
  subsp. aureus WBG10049

SEQ ID NO: 41723 - protein, 105 aa, Staphylococcus aureus; identical to SEQ ID NO: 31168
  subsp. aureus WBG10049

SEQ ID NO: 41724 - protein, 165 aa, Staphylococcus aureus; identical to SEQ ID NO: 31241
  subsp. aureus WBG10049

SEQ ID NO: 41725 - protein, 319 aa, Staphylococcus aureus; identical to SEQ ID NO: 33985
  subsp. aureus WBG10049

SEQ ID NO: 41726 - protein, 238 aa, Staphylococcus aureus; identical to SEQ ID NO: 31240
  subsp. aureus WBG10049

SEQ ID NO: 41727 - protein, 225 aa, Staphylococcus aureus; identical to SEQ ID NO: 31903
  subsp. aureus WBG10049

SEQ ID NO: 41728 - protein, 241 aa, Staphylococcus aureus
  subsp. aureus WBG10049
MKKNITNKIVLSTALLLLGTTSTQPPKEPISFSSEAKAYNISENETNINELIKYYTQPHLSFSGKWLWQNPNGTIHATLQTWVWYTHIQVFGPESWGNINQLRDKYVDIFGTKDEDTIEGYWTYDETFTGGVTPAATSSDKPYKLFLKYKDKQQTMIGGLEFYQGNKPVITLKELDFRVRQTLIKNKKLYNGEFNKGQIRITGGGNHYTIDLSKKLKLTDTNRYVKNPRHAEIEVILEKSH

SEQ ID NO: 41729 - protein, 372 aa, Staphylococcus aureus; identical to SEQ ID NO: 31901
  subsp. aureus WBG10049

SEQ ID NO: 41730 - protein, 890 aa, Staphylococcus aureus; identical to SEQ ID NO: 31883
  subsp. aureus WBG10049

SEQ ID NO: 41731 - protein, 2178 aa, Staphylococcus aureus
  subsp. aureus WBG10049
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNYTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKNFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATSVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESIKQANTNAEVDQAATVAENNIDAVQVDVVKKQAARDKITAEVAKRIEAVKQTPNATDEEKQAAVNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATAREQLTTLFNDKKQAIEANVQATVEERNSILAQLQNIYDTAIGQIDQDRSNAQVDKTATLNLQTIHDLDVHPIKKPDAEKTINDDLARVTHLVQNYRKVSDRNKADALKAITALKLQMDEELKTARTNADVDAVLKRFNVALGDIEAVITEKENSLLRIDNIAQQTYAKFKAIATPEQLAKVKALIDQYVADGNRMVDEDATLNDIKKHTQFIIDEILAIKLPAEVIKASPKVGQPAPKVCTPIKKEDKQEVRKVVKELPNTGSEEMDLPLKELALITGAALLARRRSKKEKES

SEQ ID NO: 41732 - protein, 331 aa, Staphylococcus aureus; identical to SEQ ID NO: 31235
  subsp. aureus WBG10049

SEQ ID NO: 41733 - protein, 808 aa, Staphylococcus aureus; identical to SEQ ID NO: 35738
  subsp. aureus WBG10049

SEQ ID NO: 41734 - protein, 258 aa, Staphylococcus aureus; identical to SEQ ID NO: 30518
  subsp. aureus WBG10049

SEQ ID NO: 41735 - protein, 251 aa, Staphylococcus aureus; identical to SEQ ID NO: 30505
  subsp. aureus WBG10049

SEQ ID NO: 41736 - protein, 159 aa, Staphylococcus aureus
  subsp. aureus WBG10049
MLNGNPKPEQLNKASEFTGLMDNMRYLYDDKHVSEINIKAQEKFLQHDLLFKINGSKIDGSKILKTEFNNNSLSDKYKNKNIDLFGTNYYYQCYFSADNMELNDGRLIEKTCMYGGVTEHDGNQIDKNNSTDNSHNILIKVLKTREIHYLLIYLLIRKT

SEQ ID NO: 41737 - protein, 242 aa, Staphylococcus aureus; identical to SEQ ID NO: 30522
  subsp. aureus WBG10049

SEQ ID NO: 41738 - protein, 239 aa, Staphylococcus aureus; identical to SEQ ID NO: 30171
  subsp. aureus WBG10049

SEQ ID NO: 41739 - protein, 254 aa, Staphylococcus aureus; identical to SEQ ID NO: 31226
  subsp. aureus WBG10049

SEQ ID NO: 41740 - protein, 325 aa, Staphylococcus aureus; identical to SEQ ID NO: 30484
  subsp. aureus WBG10049

SEQ ID NO: 41741 - protein, 315 aa, Staphylococcus aureus; identical to SEQ ID NO: 35728
  subsp. aureus WBG10049

SEQ ID NO: 41742 - protein, 151 aa, Staphylococcus aureus; identical to SEQ ID NO: 35733
  subsp. aureus WBG10049

SEQ ID NO: 41743 - protein, 291 aa, Staphylococcus aureus; identical to SEQ ID NO: 30390
  subsp. aureus WBG10049

SEQ ID NO: 41744 - protein, 689 aa, Staphylococcus aureus; identical to SEQ ID NO: 31861
  subsp. aureus WBG10049

SEQ ID NO: 41745 - protein, 280 aa, Staphylococcus aureus; identical to SEQ ID NO: 31858
  subsp. aureus WBG10049

SEQ ID NO: 41746 - protein, 339 aa, Staphylococcus aureus; identical to SEQ ID NO: 31219
  subsp. aureus WBG10049

SEQ ID NO: 41747 - protein, 351 aa, Staphylococcus aureus; identical to SEQ ID NO: 33991
  subsp. aureus WBG10049

SEQ ID NO: 41748 - protein, 45 aa, Staphylococcus aureus; identical to SEQ ID NO: 31097
  subsp. aureus WBG10049

SEQ ID NO: 41749 - protein, 231 aa, Staphylococcus aureus; identical to SEQ ID NO: 31216
  subsp. aureus WBG10049

SEQ ID NO: 41750 - protein, 40 aa, Staphylococcus aureus; identical to SEQ ID NO: 31854
  subsp. aureus WBG10049

SEQ ID NO: 41751 - protein, 808 aa, Staphylococcus aureus; identical to SEQ ID NO: 31853
  subsp. aureus WBG10049

SEQ ID NO: 41752 - protein, 141 aa, Staphylococcus aureus; identical to SEQ ID NO: 31214
  subsp. aureus WBG10049

SEQ ID NO: 41753 - protein, 223 aa, Staphylococcus aureus
  subsp. aureus WBG10049
NNIFRLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHEKGKGDKSEFEITYGRNMDATYAYVTRHRLAVDRKHDAFKNRNVTVKYEVNWKTHEVKIKSITPK

SEQ ID NO: 41754 - protein, 315 aa, Staphylococcus aureus; identical to SEQ ID NO: 31191
  subsp. aureus WBG10049

SEQ ID NO: 41755 - protein, 325 aa, Staphylococcus aureus; identical to SEQ ID NO: 30479
  subsp. aureus WBG10049

SEQ ID NO: 41756 - protein, 906 aa, Staphylococcus aureus; identical to SEQ ID NO: 31897
  subsp. aureus WBG10049

SEQ ID NO: 41757 - protein, 1064 aa, Staphylococcus aureus; identical to SEQ ID NO: 31896
  subsp. aureus WBG10049

SEQ ID NO: 41758 - protein, 233 aa, Staphylococcus aureus; identical to SEQ ID NO: 31039
  subsp. aureus WBG10049

SEQ ID NO: 41759 - protein, 933 aa, Staphylococcus aureus; identical to SEQ ID NO: 31892
  subsp. aureus WBG10049

SEQ ID NO: 41760 - protein, 2145 aa, Staphylococcus aureus
  subsp. aureus WBG10049
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANADPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAFLSESLSESTSESTSESLSGSTSDSTSLSDSNSESGSTSTSLSNSTSSSTSISTSISGSASTSAYKSDSVSTSLSTSTSTSLSDSTSLSTSLSDSASGSKSNSLSASMSTSDSISTRKSESLSTSTSLSGSTSESESGSTSSSESKSDSTSMSLSMSQSISGSTSVSTSESLSDSTSTSLSLSASMNQSGVDSNSASQSASTSTSTSTSESDSQSTSSYTSQSTSQSESTSTSTSLSDSTSMSRSTSQSGSTSTSASLSGSESESDSQSISTSASDSTSESTSTSLSDSTSTSNSTSESTSKAISTSASASESDSTSTSDSRSTSASTSTSMRTSTLDSQSMSLSTSTSTSVSDSTSLSDSVSDSTSDSTSTSTSGSMSASISLSDSTSTSTSASEVMSASISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSSSLNGSESVSESSSLSYSISMSDSTSTSDSDSLSGSISLSGSTSLSTSDSLSDSKSLSSSQSMSGSESTSTSVSDSQSSSTSNSQFDSMSISASESDSVSTSDSSSISRSNSTSTSLSTSDSMSGSVSVSTSTSLSDSISGSTSVSDSSSTSTSESLSDSMAQSQSTSTSASGSLSTSISTSMSMSASKSTSQSTSVSTSLSTSDSISDSTSISISGSQSAVESESTSDSTSISDSESLSTSDSDSTSTSTSGSTSGSTSTSTSESLSMSGSDSTSVSDSTSMSESDSTSVSMSQDKSDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 41761 - protein, 681 aa, Staphylococcus aureus; identical to SEQ ID NO: 31890
  subsp. aureus WBG10049

SEQ ID NO: 41762 - protein, 573 aa, Staphylococcus aureus
  subsp. aureus WBG10049
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKVTWSNLPENDKNGKTIKYLVKEVNAQGKDTTPEGYTKKEDGLVVTNTEKPIETTSISGEKVWDDKDNQDGKRPEKVSVNLLANGEKVETVDV

SEQ ID NO: 41763 - protein, 504 aa, Staphylococcus aureus; identical to SEQ ID NO: 31888
  subsp. aureus WBG10049

SEQ ID NO: 41764 - protein, 221 aa, Staphylococcus aureus; identical to SEQ ID NO: 31036
  subsp. aureus WBG10049

SEQ ID NO: 41765 - protein, 226 aa, Staphylococcus aureus; identical to SEQ ID NO: 31265
  subsp. aureus WBG10049

SEQ ID NO: 41766 - protein, 233 aa, Staphylococcus aureus; identical to SEQ ID NO: 31264
  subsp. aureus WBG10049

SEQ ID NO: 41767 - protein, 343 aa, Staphylococcus aureus; identical to SEQ ID NO: 31263
  subsp. aureus WBG10049

SEQ ID NO: 41768 - protein, 325 aa, Staphylococcus aureus; identical to SEQ ID NO: 31867
  subsp. aureus WBG10049

SEQ ID NO: 41769 - protein, 234 aa, Staphylococcus aureus; identical to SEQ ID NO: 30567
  subsp. aureus WBG10049

SEQ ID NO: 41770 - protein, 231 aa, Staphylococcus aureus; identical to SEQ ID NO: 30566
  subsp. aureus WBG10049

SEQ ID NO: 41771 - protein, 232 aa, Staphylococcus aureus; identical to SEQ ID NO: 30565
  subsp. aureus WBG10049

SEQ ID NO: 41772 - protein, 227 aa, Staphylococcus aureus; identical to SEQ ID NO: 30564
  subsp. aureus WBG10049

SEQ ID NO: 41773 - protein, 232 aa, Staphylococcus aureus; identical to SEQ ID NO: 31257
  subsp. aureus WBG10049

SEQ ID NO: 41774 - protein, 221 aa, Staphylococcus aureus; identical to SEQ ID NO: 31036
  subsp. aureus WW2703/97

SEQ ID NO: 41775 - protein, 691 aa, Staphylococcus aureus; identical to SEQ ID NO: 31040
  subsp. aureus WW2703/97

SEQ ID NO: 41776 - protein, 226 aa, Staphylococcus aureus; identical to SEQ ID NO: 31265
  subsp. aureus WW2703/97

SEQ ID NO: 41777 - protein, 233 aa, Staphylococcus aureus; identical to SEQ ID NO: 31264
  subsp. aureus WW2703/97

SEQ ID NO: 41778 - protein, 343 aa, Staphylococcus aureus; identical to SEQ ID NO: 31263
  subsp. aureus WW2703/97

SEQ ID NO: 41779 - protein, 132 aa, Staphylococcus aureus
  subsp. aureus WW2703/97
NIDVFIVLEDNKYQLKKYSVGGITKTNSKKVDHKAELSITKKDEKGKISHDDSEYKITKEEISLKELDFKLRKQLIEQHNLYGNIGSGTIVIKTKNGGKYTFELHKKLQEHRMADVIDGTSIERIEVNLKSS

SEQ ID NO: 41780 - protein, 234 aa, Staphylococcus aureus; identical to SEQ ID NO: 30567
  subsp. aureus WW2703/97

SEQ ID NO: 41781 - protein, 224 aa, Staphylococcus aureus
  subsp. aureus WW2703/97
MKLKTLAKATLALGLLTTGVITSEGQAVQAAEKQERVQHLHDIRDLHRYYSSESFEYSNVSGKVENYNGSNVVRFNPKDQNHQLFLLGKDKEQYKEGLQGQNVFVVQELIDPNGRLSTVGGVTKKNNKTSETNTPLFVNKVNGEDLDASIDSFLIQKEEISLKELDFKIRQQLVNNYGLYKGTSKYGKIIINLKDENKVEIDLGDKLQFERMGDVLNSKDIRGI

SEQ ID NO: 41782 - protein, 232 aa, Staphylococcus aureus; identical to SEQ ID NO: 30565
  subsp. aureus WW2703/97

SEQ ID NO: 41783 - protein, 227 aa, Staphylococcus aureus; identical to SEQ ID NO: 30564
  subsp. aureus WW2703/97

SEQ ID NO: 41784 - protein, 232 aa, Staphylococcus aureus; identical to SEQ ID NO: 31257
  subsp. aureus WW2703/97

SEQ ID NO: 41785 - protein, 767 aa, Staphylococcus aureus
  subsp. aureus WW2703/97
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDS

SEQ ID NO: 41786 - protein, 102 aa, Staphylococcus aureus
  subsp. aureus WW2703/97
SDSDSDSDSDSDSESDSDSDSDSDSDSDSDSDSDSDSDSDSDSGKHTPVKPMSATKDHHNKAKALPETGSENNGSNNATLFGGLFAALGSLLLFGRRKKQNK

SEQ ID NO: 41787 - protein, 787 aa, Staphylococcus aureus
  subsp. aureus WW2703/97
MLNRENKTAMTRKGMVSNRLNKFSIRKYTVGTASILVGTTLIFGIGSQEAKAAEVTNKEMKEDATSVNNDQVSKKVDTGQLNNDGNTSKVDTEQLKDENINKVANQKEVTRVENSVALEKNNNSQPSENGKLQTSDVKKTDDNNATSDDQVTTTVNSQQLNTDNTTANATMSSAPINVSKDDLKINSEEVRNVEEKRDNTDNANSSELIKPKSTAPKRLNTRMRMAAVQPSSTDSKNVNDLITSNTTLTVVDADKNNKIVPAQDYLALKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNDTTKTTANIQYPDYVSRDNNSIGSAFTETVSHAGNAEDPGYYKQTVYVNPSEKSLTNAKLKVEAYHKDYPDNVGQINKDVTKIKIYQAPKDYVLNKGYDVNTNQLIDVTEQFKDKITYGANDSVNVDFGSINNSYVVMVDTKFEYTTSESPTLVQMATLTSDGNRSVSTGNALGFTNNQSGGAGQEVYKIGNYVWEDTNKNGVQDLGEVGVKGVTVVAYDNKTNKEVGRTITDDKGGYLIPNLPNGDYRVEFSNLPQGYEVTPSKQGNNEELDSNGVSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLG

SEQ ID NO: 41788 - protein, 54 aa, Staphylococcus aureus; identical to SEQ ID NO: 35777
  subsp. aureus WW2703/97

SEQ ID NO: 41789 - protein, 858 aa, Staphylococcus aureus
  subsp. aureus WW2703/97
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQN

SEQ ID NO: 41790 - protein, 75 aa, Staphylococcus aureus
  subsp. aureus WW2703/97
DSDSDSDSDSDSDSDAGKHTPVKPMSATKDHHNKAKALPETGSENNGSNNATLFGGLFAALGSLLLFGRRKKQNK

SEQ ID NO: 41791 - protein, 434 aa, Staphylococcus aureus [sequence omitted]

SEQ ID NO: 41792 - protein, 625 aa, Staphylococcus aureus
  subsp. aureus WW2703/97
MKKQEKHAIRKKSIGVASVLVGTLIGFGLLSSKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVVNQAVNTSAPRMRAFSLAAVAADAPAAGKDITNQLTNVTVGIDSGDTVYPHQAGYVKLNYGFSVPNEAVQGDTFKITVPKELNLNGVTSTAKVPPIMAGDQVLANGVIDSDGNVIYTFTDYVNTKDDVKATLTMPAYIDPENVTKTGNVTLATGIGSTTANKTVLVDYEKYGKFYNLSIKGTIDQIDKTNNTYRQTIYVNPSGDNVIAPVLTGNLKPNTDSNALIDAQNTSIKVYKVDNASDLSESYYVNPDNFEDVTDSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDS

SEQ ID NO: 41793 - protein, 314 aa, Staphylococcus aureus
  subsp. aureus WW2703/97
DSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANTSLIWGLLASLGSLLLFRRKKENKDKK

SEQ ID NO: 41794 - protein, 652 aa, Staphylococcus aureus; identical to SEQ ID NO: 34746
  subsp. aureus WW2703/97

SEQ ID NO: 41795 - protein, 354 aa, Staphylococcus aureus; identical to SEQ ID NO: 30412
  subsp. aureus WW2703/97

SEQ ID NO: 41796 - protein, 105 aa, Staphylococcus aureus; identical to SEQ ID NO: 31168
  subsp. aureus WW2703/97

SEQ ID NO: 41797 - protein, 165 aa, Staphylococcus aureus; identical to SEQ ID NO: 31241
  subsp. aureus WW2703/97

SEQ ID NO: 41798 - protein, 206 aa, Staphylococcus aureus; identical to SEQ ID NO: 34750
  subsp. aureus WW2703/97

SEQ ID NO: 41799 - protein, 238 aa, Staphylococcus aureus; identical to SEQ ID NO: 31240
  subsp. aureus WW2703/97

SEQ ID NO: 41800 - protein, 241 aa, Staphylococcus aureus; identical to SEQ ID NO: 35990
  subsp. aureus WW2703/97

SEQ ID NO: 41801 - protein, 241 aa, Staphylococcus aureus; identical to SEQ ID NO: 31173
  subsp. aureus WW2703/97

SEQ ID NO: 41802 - protein, 372 aa, Staphylococcus aureus; identical to SEQ ID NO: 33950
  subsp. aureus WW2703/97

SEQ ID NO: 41803 - protein, 151 aa, Staphylococcus aureus; identical to SEQ ID NO: 35733
  subsp. aureus WW2703/97

SEQ ID NO: 41804 - protein, 291 aa, Staphylococcus aureus; identical to SEQ ID NO: 30390
  subsp. aureus WW2703/97

SEQ ID NO: 41805 - protein, 1896 aa, Staphylococcus aureus
  subsp. aureus WW2703/97
MNLLKKNKYSIRKYKVGIFSTLIGTVLLLSNPNGAQALTTDHNVQGGSNQALPGNSQNTNADTNRDIVNDSQNTPNAHATDNTSTNQALTNHQNVDVANQVGPAPIQPSASPAQNNNNSNANSTATEPAANTNNNLASNNNTLNVPNNTDNNDSARHLTLKEIQEDVRHSSDKPELVAIAEEASNRPKKRSRRAAPTDPNATPADPTATPADPTAGNGSAPVAITAPYTPTTDPNANNIGQNAPNEVLSFDDNNIRPSTNRSVPTVTVVDNLPGYTLINGGKVGVFSHAMVRTSMFDSGDAKNYQAQGNVIALGRIRGNDTNDHGDFNGIEKTLTVNPNSELIFEFNTMTTKNYQGMTNLIIKNADNDTVIGEKVVAYGPIWRLLKVPENVSHLKIQFVPKNDAITDARGIYQLRDGYKYYDFVDSIGLHSGSHVYVERRTMEPTATNNKEFTVTTSLKNNGNFGASFNTDDFVYKIQLPEGVEYVNNSLTKDFPSGNSGVDINDMNVTYDAANRIITIKSTGGGTGNSPARLMPDKILDLKYKLRVNNVPTPRTVTFNDTLTYKTYSQDFINSPAESHTVSTNPYTIDIIMNKDALQAEVDRRIQQADYTFASLDIFNDLKRRAQTILDENRNNVPLNKRVSQADIDSLANQMQHTLIRSVDAENAVNRKVDDMEDLVNQNDELTDEEKQAAIQVIEEHKNEIIGNIGDQTTDDGVTRIKDQGIQTLSGDTATPVVKPNAKQAIRDKAAKQREIINHTPDATQDEIQDALNQLTTDETDAIDNVTNATTNADVETAKNNGINTIGAVAPQVTHKQAARDAINQATATKRQQINSNREATQEEKNAALNELTQATNHALEQINQATTNDDVDTAKGDGLNAINPIAPVTVVKQAARDAVSHDAQQHIAEINANPDATQEERQAAIEKVNAAVAVANTNILNANTNADVEQVKTNAIQGIQAIEPATKVKTDAKNAIDQSAETQHNAIFNNNDATLEEQQAAQQLLDQAVATAKQNINAADTNQEVAQAKDQGTQNIVVIQPATQVKTDARNAVNEKAREAITNINATPGATREEKQEAINRVNTLKNRALNDIGVTSTTAMVNSIRDDAVNQIGAVQPHVTKKQTATGVLTDLATAKKQEINQNTNATTEEKQVALNQVDQDLATAINNINQADTNAEVDQAQQLGTKAINAIQPNIVKKPAALAQTNQHYSAKLVEINATPDATDDEKNAAINTLNQDRQQAIESVKQANTNAEVDQAATVAENNIDAVQVDVVKKQAARDKITAEVAKRIEAVKQTPNATDEEKQAAVNQINQLKDQAFNQINQNQTNDQVDATTNQAINAIDNVEAEVVIKPKAIADIEKAVKEKQQQIDNSLDSTDNEKEVALQALAKEKEKALAAIDQAQTNSQVNQAATNGVSAIKIIQPETKIKPAAREKINQKANELRAQINQDKEATAEERQAALDKINDLVAKAMTNITNDRTNQQVNDSTNQALDDIALVTPDHIVRAAARDAVKQQYEAKKHEIEQAEHATDEEKQVALNQLANNEKRALQNINQAIANNDVKRVESNGIATLKGVEPHIVVKPEAQEAIKASADNQVESIKDTPHATTDELDEANQQINDTLKQGQQDIDNTTQDAAVNDVRNQTIKAIEQIKPKVRRKRAALDNIDESNNNQLDAIRNTLDTTQDERNVAIAALNKIVNAIKNDIAQNKTNAEVDQTEADGNNNIKVILPKVQVKPAARQSVSAKAEAQNALIDQSDLSTEEERLAAKHLVEQALNQAIDQINHADKTAQVNQNSIDAQNIISKIKPATTVKATALQQIQNIATNKINLIKANNEATDEEQNAAIVQVEKELIKAKQQIAGAVTNADVAYLLHDGKNEIREIEPVINKKATA

SEQ ID NO: 41806 - protein, 331 aa, Staphylococcus aureus; identical to SEQ ID NO: 31235
  subsp. aureus WW2703/97

SEQ ID NO: 41807 - protein, 808 aa, Staphylococcus aureus; identical to SEQ ID NO: 35997
  subsp. aureus WW2703/97

SEQ ID NO: 41808 - protein, 258 aa, Staphylococcus aureus; identical to SEQ ID NO: 30518
  subsp. aureus WW2703/97

SEQ ID NO: 41809 - protein, 251 aa, Staphylococcus aureus; identical to SEQ ID NO: 30505
  subsp. aureus WW2703/97

SEQ ID NO: 41810 - protein, 261 aa, Staphylococcus aureus; identical to SEQ ID NO: 30506
  subsp. aureus WW2703/97

SEQ ID NO: 41811 - protein, 242 aa, Staphylococcus aureus; identical to SEQ ID NO: 30522
  subsp. aureus WW2703/97

SEQ ID NO: 41812 - protein, 239 aa, Staphylococcus aureus; identical to SEQ ID NO: 30171
  subsp. aureus WW2703/97

SEQ ID NO: 41813 - protein, 254 aa, Staphylococcus aureus; identical to SEQ ID NO: 31226
  subsp. aureus WW2703/97

SEQ ID NO: 41814 - protein, 367 aa, Staphylococcus aureus
  subsp. aureus WW2703/97
MKFKSLITTTLALGVLASTGANFNTNEASAAAKQIDKSSSSLHHGYSKIQIPYTITVNGTSQNILSSLTFNKNQQISYKDIENKVKSVLYFNRGISDIDLRLSKQAKYTVHFKNGTKRVVDLKAGIHTADLINTSDIKAISVNVDTKKQVKDKEAKANVQVPYTITVNGTSQNILSNLTFKKNQQISYKDLENNVKSVLKSNRGITDVDLRLSKQAKFTVNFKNGTKKVIDLKAGIYTANLINTGDIKNININVETKKQAKDKEAKANNQVPYSINLNGTTTNIQSNLAFSNKPWTNYKNLTAKVKSVLKSDRGVSERDLKHAKKAYYTVYFKNGGKRVIHLNSNIYTANLVHAKDIKKIEVTVKTG

SEQ ID NO: 41815 - protein, 274 aa, Staphylococcus aureus; identical to SEQ ID NO: 35568
  subsp. aureus WW2703/97

SEQ ID NO: 41816 - protein, 339 aa, Staphylococcus aureus; identical to SEQ ID NO: 31219
  subsp. aureus WW2703/97

SEQ ID NO: 41817 - protein, 351 aa, Staphylococcus aureus; identical to SEQ ID NO: 31218
  subsp. aureus WW2703/97

SEQ ID NO: 41818 - protein, 45 aa, Staphylococcus aureus; identical to SEQ ID NO: 31097
  subsp. aureus WW2703/97

SEQ ID NO: 41819 - protein, 231 aa, Staphylococcus aureus; identical to SEQ ID NO: 31216
  subsp. aureus WW2703/97

SEQ ID NO: 41820 - protein, 808 aa, Staphylococcus aureus; identical to SEQ ID NO: 31215
  subsp. aureus WW2703/97

SEQ ID NO: 41821 - protein, 141 aa, Staphylococcus aureus; identical to SEQ ID NO: 31214
  subsp. aureus WW2703/97

SEQ ID NO: 41822 - protein, 321 aa, Staphylococcus aureus; identical to SEQ ID NO: 31900
  subsp. aureus WW2703/97

SEQ ID NO: 41823 - protein, 315 aa, Staphylococcus aureus; identical to SEQ ID NO: 31191
  subsp. aureus WW2703/97

SEQ ID NO: 41824 - protein, 325 aa, Staphylococcus aureus; identical to SEQ ID NO: 30479
  subsp. aureus WW2703/97

SEQ ID NO: 41825 - protein, 965 aa, Staphylococcus aureus; identical to SEQ ID NO: 36397
  subsp. aureus WW2703/97

SEQ ID NO: 41826 - protein, 233 aa, Staphylococcus aureus; identical to SEQ ID NO: 31039
  subsp. aureus WW2703/97

SEQ ID NO: 41827 - protein, 102 aa, Staphylococcus aureus
  subsp. aureus WW2703/97
SDSDSDSESDSDSESDSDSDSDSDSDSDSRVTPPNNEQKAPSNPKGEVNHSNKASKQHQTDALPETGDKSENTNATLFDAMVALLGSLLLFRKRKQDHKEKA

SEQ ID NO: 41828 - protein, 626 aa, Staphylococcus aureus
  subsp. aureus WW2703/97
MKKRIDYLSNKQNKYSIRRFTVGTTSVIVGATILFGIGNHQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRAVRSLAVAEPVVNAADAKGTNVNDKVTASDFKLEKTAFDPNQSGNTFMAANFKVTGQVKSGDYFTAKLPDSVTGNGDVDYSNSNNTMPIADIKSTNGDVVAKATYDILTKTYTFVFTDYVNDKENINGQFSLPLFTDRAKAPKSGTYDANINIADEMFDNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTGEFKDKISYKYDNVASINFGDINKTYVVLVEGHYDNTGKNLKTQVIQENIDPATGKDYSIFGWNNENVVRYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDS

SEQ ID NO: 41829 - protein, 1351 aa, Staphylococcus aureus
  subsp. aureus WW2703/97
MSKRQKEFHDSLANEKTRVRLYKSGKNWVKSGIKEIEMFKIMGLPFISHSLVSQDNQSISKKITGYGLKTTAVIGGAFTVNMLHDQQAFAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPIKLRTFSRLAMSTFASAATTSAVTANTITVNKDNLKQYMTTSGNATYDQSTGIVTLTQDAYSQKGAITLGTRIDSNKSFHFSGKVNLGNKYEGNGNGGDGIGFAFSPGVLGETGLNGAAVGIGGLSNAFGFKLDTYHNTSKPNAAAKANANPSNVAGGGAFGAFVTTDSYGVATTYTSSSAADNAAKLKVQPTNNTFQDFDINYNGDTKVMTVTYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTITIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSIATSQSVSTSSSDSMSTSEMISDSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSTSGSTSTSTSESLSMSGSDSTSVSDSTSMSESDSTSVSMSQDKSDSTSISDSESVSTSTSMSLSTSDSTSTSESLSTSMSGSQSISDSTSTSMSNSTSMSNSTSTSMSGSTSTSESNSMHPSDSMSMHHTHSTSTSRSSSEATTSTSESQSTLSATSEVTKHNGTPAQSEKRLPDTGDSIKQNGLLGGVMTLLVGLGLMKRKKKKDENDQDDSQA

SEQ ID NO: 41830 - protein, 681 aa, Staphylococcus aureus; identical to SEQ ID NO: 34710
  subsp. aureus WW2703/97

SEQ ID NO: 41831 - protein, 493 aa, Staphylococcus aureus
  subsp. aureus WW2703/97
MNKNVLKFMVFIMLLNIITPLFNKNEAFAARDISSTNVTDLTVSPSKIEDGGKTTVKMTFDDKNGKIQNGDTIKVAWPTSGTVKIEGYSKTVSLTVKGEQVGQAVITPDGATITFNDKVEKLSDVSGFAEFEVQGRNLTQTNTSDDKVATITSGNKSTNVTVHKSEAGTSSVFYYKTGDMLPEDTTHVRWFLNINNEKRYVSKDITIKDQIQGGQQLDLSTLNINVTGTHSNYYSGPNAITDFEKAFPGSKITVDNTKNTIDVTIPQGYGSLNSFSINYKTKITNEQQKEFVNNSQAWYQEHGKEEVNGKAFNHTVHNINANAGIEGTVKGELKVLKQDKDTKAPIANVKFKLSKKDGSVVKDNQKEIEIKTDANGIANIKALPSGDYILKEIEAPAPYTFDKDKEYPFTMKDTDNQGYFTTIENAKEIEKTKDVSAQKVWEGTQKVKPTIYFKLYKQDDNQNTTPVDKAEIKKLEDGTTKTIKMVRDQKKSV

SEQ ID NO: 41832 - protein, 528 aa, Staphylococcus aureus
  subsp. aureus WW2703/97
MMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDGNKPGKEDNKKPGKEDGNKPGKEDNKKPGKEDGNKPGKEDGNKPGKEDGNKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41833 - protein, 362 aa, Staphylococcus capitis
MDTNRKFTLVKSLSIGLGTFLVGSVFLTVNDEASASTKVDAPKVEQEAPAKADAPKVEQEAPAKADAPKVEQEAPAKVDAPKVEQEAPAKVDAPKVEQEAPAKADAPKVEQKRTFVREAAQSNHSASWLNNYKKGYGYGPYPLGINGGNHYGVDFFMNVGTPVRAISDGKIVEAGWTNYGGGNEIGLVENDGVHRQWYMHLSKFNVKVGDRVKAGQIIGWSGSTGYSTAPHLHFQRMTNSFSNNTAQDPMPFLKSAGYGSNSTSSSNNNGYKTNKYGTLYKSESASFTANTDIITRLTGPFRSMPQSGVLRKGLTIKYDEVMKQDGHVWVGYNTNSGKRVYLPVRTWNESTGELGPLWGTIK

SEQ ID NO: 41834 - protein, 710 aa, Staphylococcus capitis
MDFVPNRHNKYAIRRFTVGTASILVGATLIFGVNHEAKAAETSTELTQAQADEDCSGITDQGQQEEMLTETQNTQNDYNEQQPTQQIDNDCIIDEVPMNEVEYSDDASSKAQEEDATSLENVSTDINTRNTENESVDAQSTDNCIANEQTFDNESVQEQTDNQVNNDNNIDELQKAQEYETQEENNDANQSLSESADCENDIQAGSNNYDIEAISGVSENNNDNLDNSSDVSANGDVAENVSALDSNSDCDLYADRSLDYDTDSTSYDYNTDSDYNTDCDYGSDRSLDYDTDSTSYDYNTDSDYNTDCDYGSDRSLDYDTDSTSYDYNTDSGYDTDSEYNTDCDYNTDSDYNSDCDYSSDSDSGLDYDSDSSYDSDASYDSDSSYDSDASYDSDTDCDYNSDCDSDSSYDSDTDYDSDSDNDLDSDSDSESDCDSDSDSDSDSDSDSDSDSDSDSDSDSDSDCGSDSDCDSDSDSDSDSDSDSDSDSDSDSDCGSDSDCDSDSDSDSDSDSDSDSDSDSDSDSDSDSDSDSDSDSDSDSDSDSDSDSDSDSDSDSDSDCGSDSDCDSDSDSDSDSDSDSDSDSDSDSDSDSDSDCGSDSDCDSDSDSDSDSDSDSDSDSDSDSDSDSDSGSNCDSGSEHKVPVVPTQYHEMTSHHDSNHHYNNLVMEQHHKQELPDTGYDVANNGTLFGGILAALGSLLLVGSKRRSKKY

SEQ ID NO: 41835 - protein, 434 aa, Staphylococcus capitis SK14
MPIITDVYAREVLDSRGNPTVEVEVLTESGAFGRALVPSGASTGEHEAVELRDGDKSRYLGKGVTKAVENVNEIIAPEIVEGEFSVLDQVSIDKMMIQLDGTNNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPKFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSRGIDQGIGNSILIKVNQIGTLTETFEAIEMAQKAGYTAVVSHRSGETEDTTIADIAVATNAGQIKTGSLSRTDRIAKYNQLLRIEDELYETAKFDGIKSFYNLDK

SEQ ID NO: 41836 - protein, 772 aa, Staphylococcus capitis SK14
MKNYNEKKRFSIRKYAVGVVSIVTGITIFIGGQQAHAAEETNQQINTPSHSNETTQTAQKNLKENESRPSESELSSSKTSQPQQSESTQHSQPQQTESTQSTQAQQTNPTQHPQDKENSQNQSLESTKEATNHNDTSDTSEAIDTKKEESDNQDVLPSKKTNNSERKANNTSTQDNVSSTDNKQYESESKPTETQSTETTQENNKVTQSKSSDNPSESQESTKSQDQQDPQDKPDSQHSQKSEDNLSTRDTTYPKESKQNSSSSQTQETTQESRNNKDETDNDNPQSKGAHQSSQNTQLRSTENNDDPKDSTQLKSSNKEQDTREQNNEKEVDQPIKKTPSMKQENKNTTKQSVKTDKTEKPTSTAPKTLQSHQPNKLSKQTLQAQYKNQYPVVFVHGFAGLVGEDAFTLYPNYWGGGKYNIKSELTKQGYRVHEANIGAFSSNYDRAVDLYYYIKGGRVDYGAAHAAKYGHHRYGRTYEGIMPDWAPGKKIHLVGHSMGGQTIRLMEHFLRNGNQEEIDYQRQHGGTVSDLFKGGKDNMISTITTVGTPHNGTPAADKLGTRKIVKDAMNRIGRLSGSRLLDLNLGFSQWGFKQKPNESYIEYAERVANSRIWDTEDQAINDLTTAGAEKLNKMTNLNPNIVYTTYTGAATHTGPLGFQIPDVRQLFAMDITSRIIGRDKNKNVRVNDGLVPVSSSIYPTAQAFKKVGFLNPATSKGVWQVRPVQNGWDHADLIGLDLPDFKRTGAELGKYYLGMINNMMRVEELDGLTKK

SEQ ID NO: 41837 - protein, 329 aa, Staphylococcus capitis SK14
MRYLNWSRKCLITTFLIVSSLLLAFSTITYANESKSEDSLKITTHNVYFLPTALYPNWGQSQRADLISKADYIQDQDVVIFNELFDKKASNRLLTNLQSQYPYQTPIVGKGTDGWQQTSGTYRKVKPVSGGVGIVSKWPIIEQEQHIYKKGCGADKAGNKGFAYIKINKNGKYQHIIGTHLQAEDPICIKGKDKKIRQSQMDEIKQFIKDKHIPKNEPIYIGGDLNVIKGSEEYQQMSDNLNVSLPTQFEGNAYSWDTQSNDIAKYNYPKLEPQHLDYILLDRDHAQPSSWHNKVHKVKSPEWSVKSWGKTYKYNDYSDHYPLSAYASN

SEQ ID NO: 41838 - protein, 776 aa, Staphylococcus capitis SK14
MKNRKNSYSIRKLSVGASSIIVASMLFIGGGAAHAAEQDVQGNSESHTAQSHGADNENLSEPQTNDQKDSQTVETKNDTSSAIHKDETQNQAQTNTANHLSNNDNQSNEDLTTDQSTSEQTDKDQSKGQPVDNQTTEDKQSKQDINQSNLQKQSSENNDGQESKTQQDTVNKQESAAETTPAKENQDNKQQNLDENANTTTQESSSEVAKVRNNEETSKSEDTQSDNEKEQTTSEDLKDQASSYENTSESSQNNKADETTPNNDKDKTNKTQPEQRNHKVSSSTQNKELNRETTQQSKDNEQQSDVAEKEAPVEALNNDQQFNSSQKDAKDKQLKVNDLKNDKATDHPSPSDKDDQSKKGLNTLTRNAIATPKKKSAQQAETKVKKQGDKSFPQIQYKNHDPIILVHGFNGYTADNGPVLGHNYWGGNRIKLTQELRAKGYNVSEASVSAFGSNYDRAVELYYYIKGGTVDYGAAHAAKYGHDRYGKTYAGAYRDWKPGQKIHLIGHSMGGQTVRLLEEMLRKGNPEEVKYQKKHGGDISPLYKGGQDNMVSSITTLAAPHNGTHAADIGNEPFIRQLAYDYAKFQGSKHSKVDVGLKQWGLAQRDDETNAEYLKRVKNTSKIWKTKDNAFYDLSREGTSKLNHHTSLNPNIVYKTYSGESTRPALNGRQKADINMGMSYIVTGNVIGKVPEKEWRVNDGLVSVVSAQHPFNQAYTPATKDIKKGVWQVMPVKHEWDHGDFVGSDGTEARISVDDLRAFWDSIAEEIVQNEKVTDK

SEQ ID NO: 41839 - protein, 785 aa, Staphylococcus capitis SK14
MKTRQNKYSIRKFSVGASSILIAALLFMGGGSAQAAEQNQEQGNPEKATAQSIGDENEDSNGQQATEDDTSQSAKETTSEQPNVEKDNSENANDNQTSLHNENNQNTEQQDSETEEQDTAQNTEQTKSTEEQGKEEKTSAQDATQNSTKSSDEQVESSEDSQVDNSKEDAKQEDANQADSKSEQTEEQTDVQSQPTEKSDEDKSTQSKPEVNQNQESEKDSSETQDNLKQDNPKTEDKTEEVSDSQKDLQKDTQNNQKEDDLSSDKETTQSDRAVKNQAKDETEASQTDKDQDQSQTATKPKASQQDKENDAEEQQKVSAQDEATSEETPAETDNHKTQALSVSDKANPKSEKDESSNNDKDSKDGLGTLKSNAVATTNKKSKQQTTKQQKDQTNKAAKQSQYKNHDPIILVHGFNGFTDDINPSVLAHYWGGDKMNIRQDLEENGYKSYEASISAFGSNYDRAVELYYYIKGGRVDYGAAHAAKYGHKRYGKTYEGVYKDWKPGQKVHLVGHSMGGQTIRQLEELLRNGNPEEVKYQKEHGGEISPLYKGNNDNMVSSITTLGTPHNGTHASDELGNEALVRQVVYDLGRAFGNKNSRVDFGLSQWGLKQKPNESRIDYVKRVQKSKLWKSKDNGFNDLTRDGATDLNRKTSLNPNIVYKTYTGESTHKGLFGRQKADLNLFFPFTVTANVIGKAKEKEWRENDGLVSVISSQHPFNQKYVEATDQNQKGVWQVTPTKHDWDHVDFVGQDSSDTVRSREELQQFWHGLADDLVQSEKLTSTKKA

SEQ ID NO: 41840 - protein, 509 aa, Staphylococcus capitis SK14
MKHQHKKNTLILNNFFSIRKLKFGVASITLGSALIIGAHHEAQAAESNNSQGTQNSTTIDQTNKNTNQSAQQAQSKPADTVATQNSNTQNNQATTQNAPTTNTNNSNSKSNELSQTLNFQVQKDKTNDVSHMDQYVQHPGKVIKKDDKYYFQITLDNASWWKSFRFFDENETELPTTVVDNNTEKDTKTVNMEVTPGMNNIISKVHIVIPALKYDHEYTTHIELESVIPTIEDPEPTATQNQAKQNDTTNVEQPDAGNNQAKNEKPSAPVNHTDTNNQNTKIDSQDKKDDASTDQQPVAENNQDTAQKPSAPVSDTVTNNQNAKTDNQAKKDDASKNQQTATDKKQDTKKPEAQVSDTTKKQDVKTIKKDDTSKDKQPDDDKKQDTAKKPSAPVSDTTKKQDVKTKKQDKKDDTPKDKQLDAAKHSEKLYKIHKDSNGPKPKKDQKHDKDSKEAKGKDSVVKDNSKSKTSKELPETGSKQESNSNSLVFSLIALLSSLLLLKRKNNKNI

SEQ ID NO: 41841 - protein, 733 aa, Staphylococcus capitis SK14
MNKPNNFSNDKPTQKNHYSIRKFTVGTASIIVGSFLFFGQAHAEEGTEGNTWQREAVGTVNTAGQPSTTSQDQNNQAGTGTPAATQTGQDGAKTNTADHQGQGTAEATGTQTNQADATQTNPSPNTTGQDNQATSTPQGTQTAGTGQTAPTTSTGDTQAKPHAETADQGNGATVTPSPQNDATSPAASTKPEATTGQDATSKPGTTENNSTGQGAQAGTVGAGTPTPSQPETQPNTDTTGSAKPSTSTTDQEKPNTEDHGEQTGTSAGNAQNAAGTPGETKPNQATPAPNNQDTQPGNTNNDAATTPQPGTTGQDTQGTQSKPGTTETGTAQNTGTTDTQAKPEAGNQNAGTTVTPPADKDNQAGQGTAGTTGTPAPETNNGATGTPGTTAPENNNQAGQGTAGTAGTPAPVTNNGATGTPGTTAPENNNQAGQGTASTTGTPTPESNNGATGTPGQTTPNGQDNQEKPSAPGNDQQGQDTPQIGTPGQGTQTGENGTGTTVTPSPNQNQAGNENQTKPGTDNNAGVTTPDQGTAPKPSTDQNPGTDTPEQNNQAGQGTTGTTGTPAPDTNNGATGTPGQTTPSGQDNQEKPNTNNTEQTTPTTPEQNGQLGAGVKPGTANPDQNTEVKPDDNGNPKPDTVQKPGTNQTGGDTGRNTGEDKGGQTGGDTGNTDSDNKQTVVNDEVKTSNGSKDKSELPETGLSDESDYATTVFGTITLAASLLLLRRQRKESK

SEQ ID NO: 41842 - protein, 238 aa, Staphylococcus capitis SK14
MKKTIIASSLAVGLGVVAGNAGHDAHASEATNVDKAELAQKAQSNDQSLNESPIQKGAYNVNFDYNGFNYHFESNGTHWSWNYAQNGQATPQQDVSNQTSADQVSSQQQTSQAQPEQTSAPQTEQTQQPQAKATTSYSAPTNNTASSQASTNQASSGSSVNLNSHLKQIAQRESGGDIHAINPSTGAAGKFQFLQSTWDSVAPEQYKGQSPANAPESVQDAAAVKLYNTAGASQWVTA

SEQ ID NO: 41843 - protein, 291 aa, Staphylococcus capitis SK14
MNKIDAWLTRHGLKNWLTLVVVIAFILFIILLFMFLNQGDEDTGQITITENAELRTGPNAAYPIIYKIEKGDSFKKVDKQGKWIEVQNRAGTEKGWVAGWHTNLNIHADNSKASNPLKGKTIVLDPGHGGSDQGASSNTPSKSLEKNYTLKTAKELKKLLEKEGAKVKMTRTTDKYVSLDDRNIKGDAFISIHNDSLDSSNANGATVYWLQDNQESLAQTLNSNIQKKALLTNRGARQQNYQVLRQTDVPAVLLELGYISNPTDENMIKDQLHRHVVEQAVVDGLKQYFSS

SEQ ID NO: 41844 - protein, 552 aa, Staphylococcus capitis SK14
MRKRMDFVPNRHNKYAIRRFTVGTASILVGATLIFGVNHEAKAAETSTELTQAQADEDCSGITDQAQQEEMLTETQNTKNDYNEQQPTQQIDNDCIIDEVPMNEVEYSDDASSKAQEEDATSLENVSTDINTRNTENESVDAQSTDNCIANEQTFDNESVQEQTDNQVNNDNNIDELQKAQEYETQEENNDANQSLSESADCENGIQAGSNNYDIEAISGVSENNNDNLDNSSDVSANGDAVENVSALDSNSDCDLYADRSLDYDTDSTSYDYNTDTGYDTNSEYNTDCDYNTDSDYNSDCDYSSDSDSGLDYDSDSSYDSDSSYDSDASYDSDTDCDYNSDCDSDSSYDSDTDYDSDSDSDFDSDSDSDSDSDSDSDCGSDSDCDSDSDSDSDSDSDSDSDSDSDSDSDSDSDSDSDSDSDSDSDSDSDSDCDSDSDSDSDSDSDSDSDSDSDSDSDSDSDSDSDSDSDSGSNCDSGSEHKVPVVPTQYHEMTSHHDSNHHYNNLVMEQHHKQELPDTGYDVANNGTLFGGILAALGSLLLVGSKRRSKKY

SEQ ID NO: 41845 - protein, 115 aa, Staphylococcus capitis SK14
MTQKFVACTIGSVLITLAFLVVCNQPLSAATPNENQTMNQLQLHSLKDESRYASSKPYFFKSNAVEHKHPIYQTTSKSTLPETGKSISHSPVMAGIIALVLGLVILIHKKISARK

SEQ ID NO: 41846 - protein, 206 aa, Staphylococcus capitis SK14
MSGRTSSSDSMSTSISTSTSMSNSESVSASDSNSTSTSESISASTSTSGNTSNSVSTSDSTSTSDSDSASMSTSSSESFSTSTSTSNSDSSNHQGSLVDPSGFKPSHQNPGEQHLSGSMDSSEFINSNQSNKESNFTSENEHNHNQVTQHGEKHSDQQNDKSLPNTGEDETNRGGLVSIVLTMLAGLGLIRRSKKDKNKDRKNNED

SEQ ID NO: 41847 - protein, 90 aa, Staphylococcus capitis SK14
MSTSDSASTSASNVTSNATSNSASTGESTNSSNVVQQSNHKDNSDENKELPETGNSNDANNTNVLMGAVLSLLAGLGLMKRSRKNKEDKK

SEQ ID NO: 41848 - protein, 434 aa, Staphylococcus capitis VCU116; identical to SEQ ID NO: 41835

SEQ ID NO: 41849 - protein, 1757 aa, Staphylococcus capitis VCU116
MNLFRKQKFSIRKFNIGIFSALITTVTFLAHPSQASASELDSTQPESSEGTVQNGSGQNVSTEESSAQLNNDVIQGDNKPSTTHLEQSDNLNNSQITGNTLDQTQSLTNNESNELENETNTLATNTNSTIDENAIHVDNTTQHYVEAKANDKSSKDAKNTSNPITHDTKVVREESNLPKKRSRRDLPAGDSNNANTATTINDPNLSNTGSNSIKTTLTFDDLGITTSNNRHKPEIKVLNELKGFKMINGGSVGLVNSELERTNVFHSGDPRNYQASGNVLVLGRSRGTDVNDHGGFNGVEKDFTVNPNSELIFGFNTMPANNGKGGTYLIVKNADNDKQIVKQDVQDGGIWRLVKIPDNVNRVKVQFLPNNDIMTDTRRVALLKDGYKYYSLIDSIDIASGSHLKVLPKENNDAVKNNKQFEVSTRIENDGNFAAALDTNKLIYTVKLPENFEYIDDSTVATFVNGNMPNTTIKPLSVNYDQQTNTLTFTSNGVNKSSSNQEDAKFLPNKILNIKYKLRPVNIPTPRQVTVNQSITYKTYAQYYLNTNDNTVTAQQTPFTIDVKMNKDDLEEQVNKEVIPSNYTLASFNAYKKLKAQAQTILDEEANNKPINERVSQAEIDSLLHQLQNTLINRVDAAQEINNKAQDMSDEAEANNELTTEEKEALTERIDNDKNEILSKIDDQTTDEGVEQVKNTGLTTLAADTPQPVIKPKAREAINNKVTDQKALINQNNEATHEEKNVAIQKVDNHSSESLQKIGEAETESTVNAARDEGINNISSDIPNPQQKAEARRIINQKAQDKITEINQNTQATQDERNIALNNVNQAKTQALQNIQNANTNNDVTNAKDAVINTINQLSVNPVKRKQAINELNTVAQQQKQNIQRNNEATTEEKTEAESKVERELAQATQNINSAPTNNEVDQAKTSGQNAINSANPNTTVKRMAREAIENKVASQIQQINANNKATNEEKETAINNVYAHKQEALNNVTNAHSNSDVKNVQQDGINTINLDQPNAVKKDQVILELSQKAQERKATLNQTPDATDEEKNAANTKVDQALNDGIQQINRSTSNNDVDNAKTNATQTIDNINVDVLKKPQAKEEIASKVNDKQREITNDNEGTTEEKQSAIESVNQAKVEADSGISQAQTNIEVEKAKNAGLSNIGNIHPVFNKKQQARAKINEKFKTKQDQINQTPNATQEEKNEALTRLTQAKDAVLQTISNSQSNDNVDQAQTNGIQTLDGINTTVNKKPQAKENINHVAQNHKNEIDLNNNATTEEKDDAKNLVNAAITNINNNIDNADTDAQVDSAVTTGTQTINSITPATTVKTNAKNEIAKKAESIIAKNQTSPDATDEEKAEANSKVEEAKAEANSNIQIANSNEQVKEAKDNGLNKINEISPTTTIKSEARKAVQNKVNEQIGLIKATPDATDEEKATAIAKVNSELAKVQQQINTEHTSQGVNSVKANAMTAIEQITAQAIEKETARDAVKQKANEQTDVINNNNNSTEEEKVEAIGRINNAKQEALDNINSATMNQAVTSAKNEGINNINLIQSSTSTKTNAKSDIDRKLSEQIENINQHQTATTEEKDTAVQLANQKANEAKNNIQTATDNEGVAQAKTNGISAINNIEPNAQQKPTAKQDIETKVTEQNRVIDNTANATDEEKQEAKNRVKTEENTGNQNIDQAQTNQQVIDAKTTTIDTINTIIPNVTKKPTANREIDAKFEQLKQAINSTPDATTDEKNEAIQRLIEKKMKVKI

SEQ ID NO: 41850 - protein, 318 aa, Staphylococcus capitis VCU116
LGHPAVQAESEIVAIETKGNSDVSTESKINMPRKEATPDAPIVEKDESKVNVSIIPSGLSTKMEIEYINPEGKSDTIIARKDGLTWSLSKEITGITIEPATGKVTIDYYVVYPESEITASEVHGNSDHSKLNSVIMPRKENAPEPPIVTVNEKEATVIIKPRIEATKVEINFKNKKGKAIYINVYKNGSEWSVDQVIEGIILNAHTGEIKITHLAVKDDSEIIAREYKGNSDASIAISIKAPTKVTSKESYKIKSSKVKLNVRSNEMMYTKKDKLLELPHTGESEKANKTLLSSILILGLMLLRKSRKKKNLKKEELL

SEQ ID NO: 41851 - protein, 552 aa, Staphylococcus capitis VCU116; identical to SEQ ID NO: 41844

SEQ ID NO: 41852 - protein, 115 aa, Staphylococcus capitis VCU116; identical to SEQ ID NO: 41845

SEQ ID NO: 41853 - protein, 88 aa, Staphylococcus capitis VCU116
MDSSEFINSNQSNKESNFTSENEHNHNQVTQHGEKHSDQQNDKSLPNTGEDETNRGGLVSIVLTMLAGLGLIRRSKKDKNKDRKNNED

SEQ ID NO: 41854 - protein, 238 aa, Staphylococcus capitis VCU116; identical to SEQ ID NO: 41842

SEQ ID NO: 41855 - protein, 277 aa, Staphylococcus capitis VCU116
MKNYNEKKRFSIRKYAVGVVSIVTGITIFIGGQQAHAAEETNQQINTPSHSNETTQTAQKNLKENESRPSESELSSSKTSQPQQSESTQHSQPQQTESTQSTQAQQTNPTQHPQDKENSQNQSLESTKEATNHNDTSDTSEAIDTKKEESDNQDVLPSKKTNNSERKANNTSTQDNVSSTDNKQYESESKPTETQSTETTQENNKVTQSKSSDNPSESQESTKSQDQQDPQDKPDSQHSQKSEDNLSTRDTTYPKESKQNSSSSQTQETTQESRNNK

SEQ ID NO: 41856 - protein, 785 aa, Staphylococcus capitis VCU116; identical to SEQ ID NO: 41839

SEQ ID NO: 41857 - protein, 776 aa, Staphylococcus capitis VCU116; identical to SEQ ID NO: 41838

SEQ ID NO: 41858 - protein, 329 aa, Staphylococcus capitis VCU116; identical to SEQ ID NO: 41837

SEQ ID NO: 41859 - protein, 413 aa, Staphylococcus capitis VCU116
MNKPNNFSNDKPTQKNHYSIRKFTVGTASIIVGSFLFFGQAHAEEGTEGNTWQREAVGTVNTAGQPSTTSQDQNNQAGTGTPAATQTGQDGAKTNTADHQGQGNAEATGTQTNQADATQTNPSPNTTGQDNQATSTPQGTQTAGTGQTAPTTSTGDTQAKPHAETADQGNGATVTPSPQNDATSPAASTKPEATTGQDATSKPGTTENNSTGQGAQAGTVGAGTPTPSQPETQPNTDTTGSAKPSTSTTDQEKPNTEDHGEQTGTSAGNAQNAAGTPGETKPNQATPAPNNQDTQPGNTNNDAATTPQPGTTGQDTQGTQSKPGTTETGTAQNTGTTDTQAKPEAGNQNAGTTVTPPADKDNQAGQGTAGTTGTPAPETNNGATGTPGTTAPENNNQAGQGTAGTAGTPAPVN

SEQ ID NO: 41860 - protein, 509 aa, Staphylococcus capitis VCU116; identical to SEQ ID NO: 41840

SEQ ID NO: 41861 - protein, 1113 aa, Staphylococcus capitis VCU116
MNKQHKNHSLRYANYFSIRKLTVGVASITLGTAIFLGTNHEAQAAEDTTSQAITNSAASSGQNTNTAHPTGASTSSSTNQSDQAQPKNTTQSSSDSQSTSTSQNNSNNNASNTTQSASNTSQNAQTKFHSADNLKEAIKDPAVANQPHDEGPRRPIEFSLEGSSEKTFYIEASTKNPADVIFTRDGAKVEFEVQTADSFEKFEVYNGDTKLPVNLVSFDSEKDYAYVRFPVTDGTKEVRVLATVVWGGGTNKDDYDARLVFKKPIQNDTSQFQTQQEYDTEKLLEPYRKAKTLERQVYELEKIQDKLPDNLKQEYKEKLAKAKSDLEQEVTSAKPEFENVKPTPKTLTDEKNADFVVLESTEDNPSVMDGFVQHPFKTATIDGKKYVVMQTKTDSYWKDLKVEGKRVVTISRDKTNDTRTIIFPYEDGKDVYNAIVKVVVKNIGYDGQYHVRIQNNEFAKKRVSSDSTENKSTSTDTSTSNASQNSDSSKKVTAKDYQATTYKNIYKDVVYDKNKLHKELPIFVSGHFRNAINNEESSLYEGALNPNVKIEKLNDLYKYTVHLHPGIADVGGEFYDFELFRVEYKDQPLELKTINEKNKIKEFTVTSKDLLEKIQLTGTTKYPENINNPNKSRDQAHDVTLQLYYDSARQFNNDLWNDPKERPSKPAKTTKPAPSSQNQQTTTQTNNNDQSSVPDHEVETAKVSTAFPVTIKGDLKYQKDNAQDSTYANLIEKDVKVEKVGDKYQYTFKVKEANGNSLITKRTKYQFSKITHNGENVILTDQGNKVKEAVLTTDKLLDKIQLVTKVVSKLDKVGNDVATTLVLDFPVIVKPKADSNQTNNSTNNNPNNNNATTNPVETPTTKPNETPTTKPAETQNTTSSVKPNSTEFESAITTPTVLKDEKAVDFSILKKLKDQPSAIENYVQKPFKVAVDEKGNKLVVLTIKNDSYWKEFKVEGQRVTTIARDKEHDTRTVAFPYVEGQKVYNAFVSIEVPKIGYKGNYDIRIINDEPNKEFEPIPIPKKEKPNPKRPTKLTKTSSKTKTLTVTKDRKSDQSQTVTDTKDSKSNKSQSTDKSKTLPNTGLDSSQTTIWASLLAFLGSTLLINRKNRKSDKH

SEQ ID NO: 41862 - protein, 552 aa, Staphylococcus capitis VCU116
METYKTGTVNTIINENGVDLGSINVNLYTMDNKTSVIDIHIKKKNIINENQEYISVNFNQTKFEPVLHVFAQDGSIFTNEPLEIVKAEEGFVRYIIPEYITKHVGQMQCKLFLENPENNDSTHVANFYFTVNDSGITKSVGKEIRVELLDDIVEKVMKDNVDIFKGPKGDTGEQGPAGQDGKDGKNGINGIDGVNGNPGPQGPPGRDGKDGVDGQDGSDGKSFDFESLTEEQKAEITPKLPDFSNWQQYQFTNSDGARKWLGTLAQPIETLEPGLYECSIPSDYNSVNAPADTSGKGYIAEINVTKGQSGRKHIILINNYQNNIWSKTIHTDGDDRGWVAVNPQGQKYKLTNDDGTNFSKGYTTINLNNEDEIKKIPPGIRYITKATGLPTDVSSTNGWLFKLVWSDSQLSTIYFQPYNSSQLLQRVTYNGLSEWRYINQPSTDTGWIPLPLVNGAAPDVYSDVYLPVSYRVRKNGNNKTVQIIGNIKNLSTGLVFAQLPSDITPVRNIEYKLNQRIGTSSAAAYLASDGTMKVIGALESGSTYMINFTYMV

SEQ ID NO: 41863 - protein, 90 aa, Staphylococcus capitis VCU116; identical to SEQ ID NO: 41847

SEQ ID NO: 41864 - protein, 291 aa, Staphylococcus capitis VCU116; identical to SEQ ID NO: 41843

SEQ ID NO: 41865 - protein, 146 aa, Staphylococcus caprae
DIVDKYKGKKVDLYGAYYGYQCAGGTPNKTACMYGGVTLHDNNRLTEEKKVPINLWLDGKQNAVPLETVKTNKKNVTVQELDLQARRYLQEKYNLYNSDVFDGKVQRGLIVFHTSTEPSVNYDLFGAQGQYSNTLLRIYRDNKTIN

SEQ ID NO: 41866 - protein, 146 aa, Staphylococcus caprae
DIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFDGKVQRGLIVFHTSTEPSVSYDLFGAQGQYSNTLLRIYRDNKTIN

SEQ ID NO: 41867 - protein, 146 aa, Staphylococcus caprae; identical to SEQ ID NO: 30174

SEQ ID NO: 41868 - protein, 146 aa, Staphylococcus caprae
DIVDKYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDALNGKIQRGLIEFHPSSGDSVGYDLFGAQGQYPDTLLRIYRDNKTIN

SEQ ID NO: 41869 - protein, 146 aa, Staphylococcus caprae
DIVDKYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDALNGKVQRGLIEFHPSSGDSVGYDLFGAQGQYPDTLLRIYRDNKTIN

SEQ ID NO: 41870 - protein, 146 aa, Staphylococcus caprae
DIVDKYKGKKVDLYGAYYGYQCAGGTPNKTACMYGGVTLHDNNRLTEEKKVPINLWLDGKQNTVPLETVKTNKKNVTVQELDLQARRYLQEKYNLYNSDVFEGKVQRGLIVLHTSTEPSVNYDLFGAQGQYSNTLLRIYRDNKTIN

SEQ ID NO: 41871 - protein, 146 aa, Staphylococcus caprae
DIVDKYKGKKMDLYGVYYGYQCTGGTPFKTACMYGGVTLHDNNQLEEEKKVPINLWIDGKQNTVPLGTVKTNKKEVTVQELDLQSRHYLHETYNLYNTDALNGKIQRGLIEFHPSSGDSVGYDLFGAQGQYPDTLLRIYRDNKTIN

SEQ ID NO: 41872 - protein, 146 aa, Staphylococcus caprae
DIVDKYKGKKVDLYGVYYGYQCTGGTPFKTACMYGGVTLHDNNQLEEEKKVPINLWIDGKQNTVPLGTVKTNKKEVTVQELDLQSRHYLHETYNLYNTDAFNGKIQRGLIEFHPSSGDSVGHDLFGAQGQYPDTLLRIYRDNKTIN

SEQ ID NO: 41873 - protein, 146 aa, Staphylococcus caprae
DIVDKYKGKKVDLYGVYYGYQCTGGTPFKTACMYGGVTLHDNNQLEEEKKVPINLWIDGKQNTVPLGTVKTNKKEVTVQELDLQSRQYLHETYNLYNTDAFNGKIQRGLIEFHPSSGDSVGHDLFGAQGQYPDTLLRIYRDNKTIN

SEQ ID NO: 41874 - protein, 146 aa, Staphylococcus caprae
DIVDKYKGKKVDLYGVYYGYQCTGGTPFKTACMYGGVTLRDNNQLEEEKKVPINLWIDGKQNTVPLGTVKTNKKEVTVQELDLQSRHYLHETYNLYNTDAFNGKIQRGLIEFHPSSGDSVGHDLFGAQGQYPDTLLRIYRDNKTIN

SEQ ID NO: 41875 - protein, 96 aa, Staphylococcus caprae C87
MTHAHGYGQGYGQGYGQGSASESTETPKTITTSTTETTPDKKEVTHGEKTEHSANELPETGEENQESKGLLASIASILGLSGLATLFVNRKRKTNE

SEQ ID NO: 41876 - protein, 434 aa, Staphylococcus caprae C87
MPIITDVYAREVLDSRGNPTVEVEVLTESGAFGRALVPSGASTGEHEAVELRDGDKSRYLGKGVTKAVENVNEIIAPEIVEGEFSVLDQVSIDKMMIQLDGTNNKGKLGANAILGVSIAVARAAADLLGQPLYKNLGGFNGKQLPVPMMNIVNGGSHSDAPIAFQEFMILPVGAESFKESLRWGAEIFHNLKSILSERGLETAVGDEGGFAPKFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSRGIEQGIGNSILIKVNQIGTLTETFEAIEMAQKAGYTAVVSHRSGETEDTTIADIAVATNAGQIKTGSLSRTDRIAKYNQLLRIEDELYETAKFDGIKSFYNLDK

SEQ ID NO: 41877 - protein, 1261 aa, Staphylococcus caprae C87
MNTHHKNHSLRYTNYFSIRKLTVGVASITLGTAIFLGTNHEAQAAEDTTSQPSTNTVTSSGQNTNSANPTTSSTSSSTNQTQPSHTTQATTGTQSTPTSQNNTNNNASNQTPSASSTNQSAQTQFHSADNLKEAIKDPAVANQPHDEGPRRPIEFSVEGSSEKTFYIEASTKNPADVIFARDGAKVELEVQTADSFEKLEVYNGDTKLPVNLVSFDSEKDYAYVRFPVTDGTKEVRVLATIVWGGSNRDNYDARLVFKQPIQNDTSQFQTQQEYDTEKLLEPYRKAKTLERQVYELEKIQDKLPDHLKQEYKEKLAKAKSDLEQEVTSAKTEFENVEPTPKTLTDEKNADFVVLESTEDNPSVMDGFVQHPFKTATIDGKKYVVMQTKTDSYWKDLKVEGKRVVTISRDKTNDTRTIIFPYEDGKDIYNAIVKVLVKNIGYDGQYHVRIQNNEFAKKPVLSDSTENKTTPTETSTSNASQDNNSSKKVTAKDYQATTYKNIYKDVVYDKNKLHKELPIFVSGHFRNAINNEESSLYEGALNPNVKIEKLNDLYKYTVHLHPGIADVGGEFYDFELFKVEYKDQPLELKTINEKNKIKEFTVTSKDLLEKIQLTGTTKYPENINNPNKSRDQAHDVTLQLYYDSARQFNNDLWNDPKERPSKPAKTTKPASSSSQNQQPTTQTNSTAQSPVPDHEVETTKVPTSFPVTIKGDLKYQKDNNQDSTYANLFEKDVKVEKVGDNYQYTFKVKEANGNSLITKRTKYQFSKITHNGENVTLTDQGNKVKEAILTTNKLLDKIQLKTTVVSKQDKAGNEVDTTLALDFPIVEKAPETPASPEFNDHVVDANKVPETYPITVKGDLKYQKDNNQDSTYANLIEKDFKVEKVGDKYQYTFKVKEANGNSLITKRTKYQFSKITHNGENVSLTDQGNKVKEAVLTTDKLLDKIQLVTKVVSKLDKEGNDVGTTLVLDFPVIEKPKADSNQTNNPTDSNSNINNATTNPIEKPVETPTNKTVETPTDTSTTKPVETPNTKPVETQKTTTVVKPNITEFESATTIPTMLKEEKAVDFSILKKLKDQPSIIESYIQKPFKVAIDDKGNKLVVLTIKNDSYWKEFKVEGQRVTTIARDKEHNTRTVTFPYVEGKKVYNAFVSVEVPKIGYKGNYDIRIVNNEFNKKAEPTPTPNTEKPNTKSPTKPTKVTTKTKTTTVTVTKDSKSNKAQSTNKSKTLPNTGLNSSQTTIWASLLAFLGCTLLINRKQRKDNKH

SEQ ID NO: 41878 - protein, 504 aa, Staphylococcus caprae C87
MKHQHKKNTLISNNFFSIRKLKFGVASITLGSALVIGAHHEAQAAENNDSQATQNSTTLDQTSTNTNQSTQQDQSKPSKTVDSQNSNAQNSQSTTQNAQTTNASNNNSQSNELSQPLNFQVQKDKTNDVSHMDQYVQHPGKVIKKDDKYYFQITLDNASWWKSFRFFDESDTELPTTVVDNNTEKDTKTVNIEVTPGMNNIISKVHIVIPALKYDHEYTTHIELESVIPTIEDPEPTTDQDQAKQNDTLNDNQTDASKNQVDNEKPVAPANDTDKQDVKNDNQAKTDDSSKNQQADYSNKQDTTQKTSTSESNTSDKQDVKTNKQVKKDDTSKDKDQQVVSDKKQDTTQKPVAPANDTTKKQDVKINKQDKKDDTSKDQQPDADKKQDTTQEPSYQVSDTDKQKVKTNKQDKKDNKTHKDTYDPKPKKDQKHDNDTNKDHVKGKDSKATISNSSEVKDDSKSKSSKELPETGSQHESNNNGMVFSLIALLSSLLLLKRKNNKNI

SEQ ID NO: 41879 - protein, 291 aa, Staphylococcus caprae C87
MNKIDAWLTRHGLKNWLTLVVVIAFILFIILLFMFLNQGDEDTGQITITENAELRTGPNAAYPIIYKIEKGDSFKKVDKQGKWIEVQNRAGTEKGWVAGWHTNLNIHADNSKASNPLKGKTIVLDPGHGGSDQGASSNTPSKSLEKNYTLKTAKELKILLEKEGAKVKMTRTTDKYVSLDDRNIKGDAFISIHNDSLDSSNANGATVYWLQDNQESLAQTLNSNIQKKALLTNRGARQQNYQVLRQTDVPAVLLELGYISNPTDENMIKDQLHRHVVEQAVVDGLKQYFSS

SEQ ID NO: 41880 - protein, 1757 aa, Staphylococcus caprae C87
MNLFRKQKFSIRKFNIGIFSALIATVTFLAHPSQASASELDSTQPESSEGTVQNGSGQNVSTEESSAQLNNDVIQGDNKPSTTHLEQSDNLNNSQITGNTLDQTQSLTNNESNELENETNTLATNTNSTIDENAIHVDNTTQHYLEAKANDKSSKDAKNTSNPITHDTKVVREESNLPKKRSRRDLPAEDSNNANTATTINDPNLSNTGSNSIKTTLTFDDLGITTSNNRHKPEVKVLNELKGFKMINGGSVGLVNSELERTNVFHSGDPRNYQASGNVLVLGRSRGTDVNDHGGFNGVEKDFTVNPNSELIFGFNTMPANNGKGGTYLIVKNADNDKQIVKQDVQDGGIWRLVKIPDNVNRVKVQFLPNNDIMTDTRRVALLKDGYKYYSLIDSIDIASGSHLKVLPKENNDAVKNNKQFEVSTRIENDGNFAAALDTNKLIYTVKLPENFEYIDDSTVATFVNGNMPNTTIKPLSVNYDRQTNTLTFTSNGVNKSSSNQEDAKFLPNKILNIKYKLRPVNIPTPRQVTVNQSITYKTYAQYYLNTNDNTVTAQQTPFTIDVKMNKDDLEEQVNKEVIPSNYTLASFNAYKKLKAQAQTILDEEANNKPINERVSQAEIDSLLHQLQNTLINRVDAAQEINNKAQDMSDEAEANNELTTEEKEALTERIDNDKNEILSKIDDQTTDEGVEQVKNTGLTTLAADTPQPVIKPKAREAINNKVTDQKALINQNNEATHEEKNVAIQKVDNHSSESLQKIGEAETESTVNAARDEGINNISSDIPNPQQKSEARRIINQKAQDKITEINQNTQATQDERNIALNNVNQAKTQALQNIQNANTNNDVTNAKDAAINTINQLSVNPVKRKQAINELNTVAQQQKQNIQRNNEATTEEKTEAESKVERELAQATQNINSASTNNEVDQAKTSGQNAINLANPNTTVKRIAREAIENKVTSQIQQINANNKATNEEKETAINNVYAHKQEALNNVTNAHSNSDVKNVQQDGINTINLDQPNAVKKDQAILELSQKAQERKATLNQTPDATDEEKNAANTKVDQALNDGIQQINRSTSNNDVDNAKTNATQTIDNINVDVLKKPQAKEEIASKVNDKQREITNDNEGTTEEKQSAIESVNQAKVEADSGISQAQTNTEVEKAKNAGLSNIGNIHPVFNKKQQARAKINEKFKTKQDQINQTPNATQEEKNEALTKLTQAKDAVLQTISNSQSNDNVDQAQTNGIQTLDGINTTVNKKPQAKESINHVAQNHNNEIDLNNNATTEEKDDVKNLVNAAITNINNNIDNADTDAQVDSAVANGTQTINSITPATTVKTNAKNEIAKKAESIIAKNQTSPDATDEEKAEANSKVEEAKAEANSNIQIAKSNEQVKEAKDNGLNKINEISPTTTIKSEARKAVQNKVNEQIGLIKATPDATDEEKATAIAKVNSELAKVQQQINTEHTSQGVNSVKANAMTAIEQITAQAIEKETARDAVKQKANEQTDVINNNNNSTEEEKVEAIGRINNAKQEALDNINSATMNQAVTSAKNEGINNINLIQSSTSTKTNAKSDIDRKLSEQIENINQHQTATTEEKDTAVQLANQKANEAKNNIQTATDNEGVAQAKTNGISAINNIEPNAQQKPTAKQDIETKVTEQNRVIDNTANATDEEKQEAKNRVKTEENTGNQNIDQAQTNQQVIDAKTTTIDTINTIIPNVTKKPTANREIDAKFEQLKQAINSTPDATTDEKNEAIQRLIEKKMKVKI

SEQ ID NO: 41881 - protein, 955 aa, Staphylococcus caprae C87
MPHIELDETNGKVTIGYQAVQAESEIIATETKGNSNSSTESKVTMPRKETTPEAPTIEADEEHANVEVTPKDEVTKLVINYTNQEGQTDSIIANKNDGTWSLNKKVSHVELDNQTSKITIGYQAVQAESEIVTTEIKGNSDPSIESKVNMPRKEVAPDGPTLTSDYDNVSVSISPSNKSDKMTIKYLDVNDQIATAIATKTNQNWSLNNDILGFSINSQTGKVTISHVAVQPESDIIATESGGNSDDSIAKHIIMPAKETKPEPPVVQSNINVPNVEIIPHHDVTKLDIHYTDIEGQPAIITATKVGKLWNINKNISNIELDESTGKVTIGYQTVQAASEVEATETKGNSDASAKSKVTMPRKEATPDAPTIEASEEQVNVEVTPKDEATKLVINYTNPEGQSDSIIASKNGEIWSLNKEVPNIQLNETTGKVKIGYQAVLAGSEISATETKGNSDASMESKVNMPIKVPTPDAPIIEKYVSDASVGISPKGEVTQLIIKYITPEGKVDSIIASKNEETWSLNKEVPHIQLDKATGKVIIGYQVVQAGSEVIAIATQGNSDASTESNVNMPIKEVTPNAPAVEASESHVYVEVTPKDESTKLVINYTNPEGQTDSIIASKNGETWSLNKEVPHIQLDKATGKVKIGYQAVQAESEIVATETKGNSDTSTKSKIIMPRKEATPDAPIVEKDERDVNVSIVPSGLSTKLEINYLNPKGQSEKILVNKNGHIWSLSKEITGITLEPTTGKVTIDYQVVYPESKITASGLKGNSDYSKLNSVIMPRKEKAPEPPIVTINEEEATVIIKPKTEATKVKINFKNKKGKMTYINIYKNGSEWSTDQVIKGIILNSHTGEIKITNLAIEERSEIVAREYKGNSDASVAIIIKVPSKVTNREVYKIKTSKVKLNDGSNEIKHIEKDKLKELPHTGENNQTNKTLLSSILILGLMLLRKSRKKEI

SEQ ID NO: 41882 - protein, 381 aa, Staphylococcus caprae C87
MTTMKNNKPRDLKQFPSLPSKKYFSYGTASALTLALYLFAGNGSAQAEDNNATNSNTSPKTIQTESDKTNTTTANNVTHKSTKNLNDYIDGTPNEDPDEEEDSGTYEVPILYVTVWLDDQGNIIKDAVEDNKTPASERVPVKIPGYQHFRTSVSDGITKFIYRKVNSSQTANSATSSSPKKDESNSSEVNSSKPTTQKDPEQPTQAEPTKPPTQKDPEQPKKAEPTKPPTQKDPAITNEKQKDDQNIVNDKPSLNVTVWLDDKGNIIKDAVEDDKTSKNQRGVIQISGYKYIKTVTEDGITKHIYKKVELKQEKKTSEVTKVKNNITKRMEDNKEKTSQNQKNSEKELPETGVKEQSFNPALLMLLAGLGLIGIFRNKIKE

SEQ ID NO: 41883 - protein, 241 aa, Staphylococcus caprae C87
MKKTIIASSLAVGLGVVAGNAGHDAHASEATNVDKAELAQKAQSNDQSLNESPIQKGAYNVNFDYNGFNYHFESNGTHWSWNYAQNGQATPQQDVSNQTSADQVSSQQQTSQAQQAQPEQTSAPQTEQTQQPQAKATTSYSAPTNNTASSQASSNQASSGSSVNLNSHLKQIAQRESGGDIHAINPSTGAAGKFQFLQSTWDSVAPEQYKGQSPANAPESVQDAAAVKLYNTAGASQWVTA

SEQ ID NO: 41884 - protein, 60 aa, Staphylococcus caprae C87
MTSHHDSNHHYNNLVMEQHHKQELPDTGYDVANNGTLFGGILAALGSLLLVGSKRRSKKY

SEQ ID NO: 41885 - protein, 115 aa, Staphylococcus caprae C87
MTQKFVTCTISIVLITLAFLVVCNQPVSAATPNENQTMNQLQLHSLKDDSKDASSEPYFFKSNAVEHKHPIYQTTSKSTLPETGKSISHSPVMAGIIALVLGLVILIHKKISARK

SEQ ID NO: 41886 - protein, 136 aa, Staphylococcus caprae C87
MSTSTSDSISTSTSTSNSDSSNHQGSLVDPSGFKPSHQNPGEQHLSGSMDSSEFINSNQSNKESNFTSENEHNHNQVTQHGEKHSDQQNDKSLPNTGEDETNRGGLVSLVLIMLAGLGLIRRSKKDKNKDRKNNED

SEQ ID NO: 41887 - protein, 787 aa, Staphylococcus caprae C87
MKTRQNKYSIRKFSVGASSILIAALLFMGGGSAQAAEQNQEQGNPEKATAQSIGDENEDSNGQQATEDDTSQSAKETTSEQPNVEKDNSENANDNQTSLHNENNQNTEQQDSETEEQDTAQNTEQTKSTEEQGKEEQTSEQDTTQDSTKSSDEQVESSEDSQVDNSKEDANQEDADQADLKSEQTEEQTDVQTQPTEKSDEDKSTQSKPEVNQNQESEKDSSETQDNLKQDNPKTEDKTEEVSNSQKDLQKDTQNNQQKDDLSSDKETTQSDRAVKNQAKEETEASQTDKDQTQTATATATKPKASQQDKENDAEEQQKVSAQDEATSEETPAETDNHKTQALSVSDKANPKSEKDESSNNDKDSKDGLGTLKSNAVATTNKKSKQQTTKQQKDQTNKAAKQSQYKNHDPIILVHGFNGFTDDINPSVLAHYWGGDKMNIRQDLEENGYKSYEASISAFGSNYDRAVELYYYIKGGRVDYGAAHAAKYGHKRYGKTYEGVYKDWKPGQKVHLVGHSMGGQTIRQLEELLRNGNPEEVKYQKEHGGEISPLYKGNNDNMVSSITTLGTPHNGTHASDELGNEALVRQVVYDLGRAFGNKNSRVDFGLSQWGLKQKPNESRIDYVKRVQKSKLWKSKDNGFNDLTRDGATDLNRKTSLNPNIVYKTYTGESTHKGLFGRQKADLNLFFPFTVTANVIGKAKEKEWRENDGLVSVISSQHPFNQKYVEATDQNQKGVWQVTPTKHDWDHVDFVGQDSSDTVRSREELQQFWHGLADDLVQSEKLTSTKKA

SEQ ID NO: 41888 - protein, 776 aa, Staphylococcus caprae C87
MKNRKNSYSIRKLSVGASSIIVASMLFIGGGAAHAAEQDVQGNSESHTAQSHGADNENLSEPQTNDQKDSQTVETKNDTSSAIHKDETQNQAQTNTANHPSNNDNQSNEDLTTDQSTSEQTDKDQSKEQPVDNQTTEDKQSKQDINQSNLQKQSPENNDGQESKTQQDTVNKQESAAKTTPAKENQDNKQQNLDENANTTTQESNSEVAKVRNNEETSKSEDTQSDNEKEQTTSEDVKDQASSYENTSESSQNNKADETTPNNDKDKTNKTQPEQRNHKVSSSTQNKELNRETTQQSKDNEQQSDVAEKEAPVEALNNDQQSNSSQKDAKDKQLKVNDLKNDKATDHPSPSDKDDQSKKGLNTLTRNAIATPKKKSAQQAETKVKKQGDKSFPQIQYKNHDPIILVHGFNGYTADNGPVLGHNYWGGKRIKLTQELRAKGYNVSEASVSAFGSNYDRAVELYYYIKGGTVDYGAAHAAKYGHDRYGKTYAGAYRDWKPGQKIHLIGHSMGGQTVRLLEEMLRKGNPEEVKYQKKHGGDISPLYKGGQDNMVSSITTLAAPHNGTHAADIGNEPFIRQLAYDYAKFQGSKHSKVDVGLKQWGLAQRDDETNAEYLKRVKNTSKIWKTKDNAFYDLSREGTSKLNHHTSLNPNIVYKTYSGESTRPALNGRQKADINMGMSYIVTGNVIGKVPEKEWRVNDGLVSVVSAQHPFNQAYTPATKDIKKGVWQVMPVKHEWDHGDFVGSDGTEARISVDDLRAFWDSIAEEIVQNEKVTDK

SEQ ID NO: 41889 - protein, 246 aa, Staphylococcus caprae C87
MKKSKGALFMNKKTLFSIRKLSVGIASVAIGGLLFISSGYSAHAAEDDNPSNSVDNTIKDTSGSENQDSTNTAGNTENNNNEDNNTPANTASGEQDQNSGNVTENGNDSSKQDGDQDKEAPKDDNGSSEATNKESGNTVEGTTHKVAAGETIEEIAKEHNTTVNQIAKDNGISNPNLVVAGTDLVINQPSSSHVNNDKVTSESHNANSNELPETGEGSGINVGLTGGLALAAGAALVASRRRKEQE

SEQ ID NO: 41890 - protein, 329 aa, Staphylococcus caprae C87
MRYLNWPRKCLITTFLIVSSLLLAFSTITHANESKSEDSLKITTHNVYFLPTALYPNWGQSQRADLISKANYIQDQDVVIFNELFDKKASNRLLTNLQSQYPYQTPIVGKGTDGWQKTSGTYRKVKPVSGGVGIVSKWPIVEQEQHIYKDGCGADKAGNKGFAYIKINKNGKYQHIIGTHLQAEDPICIKGKDKKIRQSQMDEIKQFIKDKHIPKNEPVYIGGDLNVIKGSEEYQQMPENLNVSLPTQFEGNAYSWDTQSNGIAKYNYPKLEPQHLDYILLDRDHAQPSSWHNNVHKVKSPEWSVKSWGKTYKYNDYSDHYPLSAYASN

SEQ ID NO: 41891 - protein, 110 aa, Staphylococcus caprae C87
MDFLPNKLNKYSIRRFTVGTASILVGSTLLFGIGNEAHAAEEHQKSNTTENVADSNASEAPTKEEAPSNEATSEAPTKEEAPSNEATSEAPTKEEAPSNEATSEAPTKEE

SEQ ID NO: 41892 - protein, 99 aa, Staphylococcus caprae C87
MGKRRQGPINKKVDFLQNKLNKYSIRKFTIGTASILVGATIFFGSADHEAKAAEENQVESITQINEKAETENDVETSKPETAKAETENDVETSKPEAAK

SEQ ID NO: 41893 - protein, 99 aa, Staphylococcus caprae C87
DQPTPDEPGNPDQPTPDEPGNPDQPTPDEPGNPDQPTPDEPGNPDQSKNVNHSTINKDHLPDTGDNSKSNQGILAGSLLSILGSLFIFGRRKNKDNSEK

SEQ ID NO: 41894 - protein, 772 aa, Staphylococcus caprae C87
MKNYNEKKRFSIRKYAVGVVSIVTGITIFIGGQQAHAAEETNQQINTPSHSNETTQTAQKNLKENESRPSESELSSSKTSQPQQSESTQHSQPQQTESTQSTQAQQTNPTQHPQDKENSQNQSLESTKEATNHNDTSDTSEAIDTKKEESDNQDVLPSKKTNNSERKANNTSTQDNVASTDNKQYESESKPTETQSTETTQENDKVTQSKSSDNPSESQELTKSQGQQELQDKTDSQDPQESKDKSSTHDTTYSKDSKQNSSSSQPQETTQESRNNKDETDNDNPQFKGAHQSSQNTQLRSTENNDDPKDSAQLKSSNKEQDTREQNNEKEVDQSIKRTPSTKVENKNTTKQSVKTDKTERPTSTAPKTLQSHQPNKLSKQTLQAQYKNQYPVVFVHGFAGLVGEDAFTLYPNYWGGGKYNIKSELTKQGYRVHEANIGAFSSNYDRAVDLYYYIKGGRVDYGAAHAAKYGHHRYGRTYEGIMPDWAPGKKIHLVGHSMGGQTIRLMEHFLRNGNQEEIDYQRQHGGTVSDLFKGGKDNMISTITTVGTPHNGTPAADKLGTRKIVKDAMNRIGRLSGSRLLDLNLGFSQWGFKQKPNESYIEYAERVANSRIWDTEDQAINDLTTAGAEKLNKMTNLNPNIVYTTYTGAATHTGPLGFQIPDVRQLFAMDITSRIIGRDKNKNVRVNDGLVPVSSSIYPTAQAFKKVGFLNPATSKGVWQVRPVQNGWDHADLIGLDLPDFKRTGAELGKYYLGMINNMMRVEELDGLTKK

SEQ ID NO: 41895 - protein, 747 aa, Staphylococcus carnosus
MNATKHQHTFSIRKSAYGAASVMVASSIFVIGGGVAEANDQTTQTTTPLEVAQTSQQETHTHQTPVTSLHTATPEHVDDSKEATPLPEKAESPKTEVTVQPSSHTQEVPALHKKTQQQPAYKDKTVPESTIASKSVESNKATENEMSPVEHHASNVEKREDRLETNETTPPSVDREFSHKIINNTHVNPKTDGQTNVNVDTKTIDTVSPKDDRIDTAQPKQVEAPKENTTAQNKFTSQASDKKPTPRSAQDPLESTCMHVEHDAEENVEHDAEENVEHDAEENVEHDAEENVEHDAEENVEENVEENVEENVEENVEENVEENVEENVEENVEENVEENVSSLDALAKAKADALKEFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALPLESFAQAPKEEDNNKPGKEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41896 - protein, 666 aa, Staphylococcus carnosus
MNATKHQHTFSIRKSAYGAASVMVASSIFVIGGGVAEANDQTTQTTTPLEVAQTSQQETHTHQTPVTSLHTATPEHVDDSKEATPLPEKAESPKTEVTVQPSSHTQEVPALHKKTQQQPAYKDKTVPESTIASKSVESNKATENEMSPVEHHASNVEKREDRLETNETTPPSVDREFSHKIINNTHVNPKTDGQTNVNVDTKTIDTVSPKDDRIDTAQPKQVEAPKENTTAQNKFTSQASDKKPTPRSAQDPLESTCRHASLDALAKAKADALKEFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALPLESFAQAPKEEDNNKPGKEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 41897 - protein, 1435 aa, Staphylococcus carnosus
  strain TM300
MMKYMTKQQKKNNVFQPQSKNRYRIRKFSVGLASVLFGTFLIYANPANHAEAAETEAASSPQIEKVNQPSTATPENIDQASKNNQPETSENSQLQNQQPKANATDQPLIQNEIQTTPENNVVTREAQPEAPTSETTNTPNQNEIQQPNYHAPSPEAKAKPIESIQGIKEQVYSKSVTVYPASTVAKTAGEKRGINQARESLGLIVPQNKKLYIRQAKGSNEADLRVDLMTDDSKQIKNATVSKNGAWNSISTGIDSAAFLRIPVGLNHNPIVEYYVEDDAGITLPTFRKEGDQQAFLDDWKKRDTPYGYVDGDKIAFLIPKIDLPRVEQFGVNPTNLSYKNIDDMINYYEDIIKHYDEWVGLNDDINSVHYNVPQKYFTIADKNGFGLAYYSSNLMGSNNPSMYGYLVKGWLALHEVGHGYDGIMVNDEDMNLMEVENNILANQYQTTVMGIDNGWLYEGHQESTQRDIHNRIINANGTFKFGNIGYRERLDFMTKMVRLTGIDGFTEMWKGIREEEAAADKLHNPFIQDVPKWINTYWLADQGVNGTAYFDLYNIDLSQVLKDKLASYNNSFAYPLAMLIQDKAELERIKQKLNLATEYELVKSSDLADISIFSNAEITLNLNGQTLPENVKVSLLENGKEVAQATVKDGKAVFPHIRAGVYQIAAPLSLENALPRSQYLIVKEAGNNTATLDYPTYEGTQSNVTQQLSLRGLSNREFAFVDYDPDKKTIKFVENPGQPHFYFNDEYVHVKIEKADGTVVLDESLVGSKNLPYKVQEFNLDYGDKIIVRHREPAARRKVVRKETNQDLVFPYASNETVTYTLTDKGFIINDETEADANRRYSTAITSDVDKIADEIKANPNRNYRTQLFHVLQGTKFVNGAIKAELEGILQPLVEKYYVIEPIVNHIERGATTITGEGQLESTIIVTFPNQISSMVEVDTERKWKVDVPEGLILEHNDVTLIKAIGELGSVSNEVIGKVEDSISPEAPHINEIEAGANEIKGTSEPNSTVVITLPGGTIVEVETDNNGNWKLETNDKLSNGSTIEAAAKDLAGNVSEKVSIIVKDTIPPAPPTVNPLKSTDTELSGTAEPNSKITIKLNDRIVTVETNAAGQWKYILDEHTQLKGDTVVIVTATDKADNQSLNTEAIVENIITPIPDNAEKTPEAVEEPNESDEIEEDTWGLIDGKGNAEAIKNSNLDYEFNDTKTEESTDDCDIEETEKEESDKVVAPLPESEDKALEVPTDQTKDEESHESNGATVNRVGTKAGSKNLPVNTNNQQVQVEKVEKSYKYKKEVTHTIQPLPREEIVIDEPEIITVTSNPVHTEETVLKEKHPSTKSNIFGSKIGEVKEKLNNTSVNSKPFIANEKIKNNQLHISNTIENNYSIYKPKKEDVVQSKLPMTGISNKDDISPLKGLVLISGLVLLGIATNRRKDEY

SEQ ID NO: 41898 - protein, 787 aa, Staphylococcus carnosus
  strain TM300
MEKRENKYSIRKFAIGTSSILVASLFFIGSGGADAAEASPEKQSDAAQVQESVDTTQLPDKQSESQQQATQNQTETLLSSESVEQPEQPEIERPSEQPNLHKDTVNPDKSSEEANTNQPAPSAQPQPVSSQKEQSESTNKNEVSQTDQHQTQTDIQNDINNQTSSTSDNTSEQPKETSETEKTPAALKQTPEKEDAKAQSNAATEQASQTTSNKDSQYPIEKITEDTLKHVQNENKANKTNDVSKQAFPNKKTEPPVSKNETAHNPKKVGTDAQTDLSGVVHNVKQNVEQVFPKNENHSNEQSEQPDYNTETAIKQPTQSITEQAQPPEPQSAPKSTSSNQDNNFVLKQTSNQNEPNTKQPEDNKKNDNQKGIEVLKSNAAATTNNKNTVANAKPVTDQTNKQAAQKQYKNQDPIILVHGFNGLVGETAGPTSGNYWGGDRTDLQKDLENNGYNVYEASIGAYGSNYDRAVELYYYIKGGTVDYGAAHAEKYGHERYGKTYEGVYPEWQPGQKVHLVGHSMGGQTIRQLEEFLRNGNQEEIDYQKAHGGTISPLFQGNHDNMISSITTVASPHNGTHAADVGNEAFIRQVLYDNMKLQGNKYSQVDYGLAQWGFKQGKNESYPDYVERIKKQSKLWTTTDNAIYDLSRKGANELNERTSLNPNIVYKSYTGESTRPGLNGRQRSDIHMAASKRLTGNVIGKADEKEWRENDGLVSTISAQHPFGQNATPATDEVQKGVWQVSPIQHDWDHGDFVGTDATEAQIKTEDLRQFWLGIAEDAVKSEAVTD

SEQ ID NO: 41899 - protein, 884 aa, Staphylococcus carnosus
  strain TM300
MENNDFFKSRKNRYSIRKMTAGAASIIVGITLFGNAHAAQAAEQTDNGDTKAQTSTQTTADSTKQTVGNNSSATSENTNLVEQNTNVTSQNSSNDTTAQSQLDNTKTQTQQAQSPNEQSSQPNPEDSVGEKSQPVTQNAPTTSEQKTENTANENSSVQETNNQTKEQKTDQTDQSQLVKENQTNSETINQTKEQVQPSEQKTDSTEATKNQRSDQTTSLATPKDEVESNPENNAEATKPVTSVDKNTNDNPIVSKNQDSTASRVEAPQTDSSNPVETTVPEPFSAPVGETTKSLEEQNPVNQSEGQKALSTSQQPVDNGAETDVPNENPSFDPNSSAVTDANNPSLGNVETNADSLKAASDAVKNYSNQKDSTEVQATPPRTFARFSSLSQPASTSSNASAQTFSAQAAPVDATAQAAPAGTNVNDQVTASNYKLSTKTVDANDSGSTDMSVDLSVADSVKSGDYFTVQFPKYLNYFGNSTPQSTKIPDLMNGDQVVASGAFNPDDNSLTYTFTDYVDTHDNVTGSFNLPLWADRNNAKDSGNYPVTTTVAGEAFNDNVQINYRTNDSQLSSNIDSFITHTDQATGDYQQVIYVNPQGKEAYNTKVNLYNYWPNQNTPGDSSAQLNPDVTSYKIYEVRNGQEMYPSYYLDENNPNLVDVTDWNNQDYNFNPTYSTDANGGEVLTLDFQNLTSNGSQYIIVLDSKSENGNRESIKTRVEMSSDVTPDGQGHNYYTWDNENIYLQGSGEAIGDDTDADADADADADADADADADSDADADSDADADADSDADADSDADADADSDADADADSDADADSDADADADADGDHPGEPHHDTDGDNGHHGSGDKELPDTGNDNKQAGLFGGLFAALGSALLFGRRKKDKKE

SEQ ID NO: 41900 - protein, 353 aa, Staphylococcus carnosus
  strain TM300
MKRLLFLMVSVLFLLSACSSNKSEEKAEADEERGEATDKMKLFRVGQTVTADGVDIKVMKAEYVNDYDEYSAPENGKVLKVYLKFKNNNKDQVLVDSSAFSMKVRGENYPEWYGGDGTDGMFSHQLNQGNTATGTLIYDVPESNFYTLEMDTNFNLKNVKAKWNISKAMIKEGNGGSDETEVTKTSSSKDDDSDSDSKDYPYTADEYNALVDEYNALTDGEKMNHVTRGVTNKEYNDLAARVEKLYEELGAEYEKEYQKQLDQEEAEWQKEQDRLDKEFDAEMKRQDEAYAREEAQRQKQEAADQKAYEAEQKRIEEQEAREAAAAEKQEQELARQEAEQQKQLDKEASMTEE

SEQ ID NO: 41901 - protein, 242 aa, Staphylococcus carnosus
  strain TM300
MKKQIIKKVILSTSITLMGLGAVSTFNSDPSLSSQVHAAQFQGQNQADELKKYYSQTPEIFSNKKLTQVEEGSDKGKIYVKIQSSWGAFINVIGNQSWGNVNKLRGKQVDVFGIKDKPTSQYWWAYTEYFTGGVTPAANPSAPVYPIKVTVKKNAHVKSSFDIKAFETRKDKITLKELDFQIRKALINNNNLYSNGQNTGTVQITTKDNQLFTFDLNKRLENERANVYVDGKNIATIIADIK

SEQ ID NO: 41902 - protein, 434 aa, Staphylococcus carnosus
  strain TM300
MPIITDVYAREVLDSRGNPTVEVEVLTESGAFGRALVPSGASTGEYEAVELRDGDKDRYLGKGVTKAVENVNEKIAPEIVEGEFSVLDQVSIDKMMIQLDGTENKGKLGANAILGVSIAVARAAADLLGQPLYKYLGGFNGKQLPVPMMNIVNGGSHSDAPIAFQEFMILPVGADSFKESLRWGAEIFHNLAKILKKRGLETAVGDEGGFAPKFHGTEDAVDTILEAIKAVGLEPGKDVYLGFDIASSEFYENGVYDYTKFEGPEGAKRTSAEQVDYLEELVNKYPIITIEDGMDENDWDGWKQLTDRLGKKVQLVGDDLFVTNTKKLSEGIEKGIGNSILIKVNQIGTLTETFDAIQMAQKAGYTAVISHRSGETEDTTIADIAVATNAGQIKTGSLSRTDRIAKYNQLLRIEDELYETAEFDGIHSFYNLDK

SEQ ID NO: 41903 - protein, 4244 aa, Staphylococcus carnosus
  strain TM300
MKSRKSKRLDFLPNIYNKYSIRKFTVGTASILLGSTLIFGINHDAEAAENENTTEAAQTSNVTGETEQSVQSSNSNSNEVNQVKSEKTNTAETVKEQVSEKAQEATKATENKIELAKEEVTQPSTSVENERAVTGSKEAIENNKTSQSDVSDSVGSFSVPETPVQSEFVTAVEVPEAFVEQYKASSNHQQLVRNLLEENYEQEDVDGILSKIKVDYDSITPESLYSEILKAGIEYANEQTSKYTVYAVRSMPDEGVSYSTRSTADTNFDDAHTASNVDIPTDVSTSEAIGALKASASIDPVRGIIITGDGKTYVGQEPARYVITAKPDRVHNKMDFEVKYYATEGTGQTHALDLGGFTFGDGFDTRQGVPIPTTVTIVGAPRSQPSTVNLLEGRAKPGYPKGYALESRPFLTDTAITNGGYGDVKFSVPVKNWNSDLSVNGFVMMYPNGNGYSNNLDPYSTQNYFNEKMQVVLDGNVDFNITRMLDKTEESIPYETKYVTSSDIPANTQRVKQQGVLGTKEIDKVISYYKNIELGSGDITEKITVQPVTEIIELGVGTPANAANSVILPPVVDPKLSGENVVTGETEPNVPVTIYVGPTTYRTTSDATGKFRQPLNVPLKQGDVVTATINKGGNTSLPGKTIVPRDGKTPNLEFTNTRTNRKGMNGTLVTVTNADTGEKIGETFIPDGQKGDKGDKGDTGDQGETGPAGRAGLDGRDGRDGKNGSDGKSILITSITPNQDGDIVVSFSDGNKVVIPKGAKGDKGDKGDSISISKIDTLPDGSRKVFFNDGHTAILPKGDKGDKGDTGADGQSITVTNVKKLPDKTIVTFSDNYEVTIPGGPKGDKGDQGVAGPKGDKGDTGETGATGAQGPKGDKGDQGVAGPKGEQGDSIRITSTEPQANGDIKVNFSDGKSIIVPKGAKGDKGQDAAPLTVTGETKDANGNTVAHFSDGRTATISKGDKGDTGAQGLKGDKGDTGAQGAKGDKGDTGATGAAGKDAKPLTVTSESKDANGNTVAHFSDGSQITISKGDKGAKGEKGDSITITSTEPQANGDIKVNFSDGKSIVVPKGAKGDKGQDAAPLTVVKETKDAQGNTVVHFSDGKTATISKGDKGDTGAQGAKGDRGETGATGAQGAKGETGATGLKGDKGDSISITSITPQPNGDTKVVFSDGKELNIPKGAKGDKGQDAAPLTVTETTKDNDGNTVVHFSDGKTATISKGDTGATGAQGPKGDPGQNAAPLTVTGERKDTAGNTVVSFSDGSTATISKGDKGDKGNTGDKGDSITIKRVEPQTNGDIKVVFSDGKEVNIPKGAKGDKGQDAAPLTVTETTKDNDGNTVVHFSDGKTATVSKGDTGAKGADAKPLTVTGEAKDKDGNTVVSFSDGTSVTVNKGDRGEAGAKGEKGDRGESGTSIAIDKIETLPTGATKVTFSDGKTFEIPKGKDGTSVTITETKTLPNGNKQVTFSDGKTLEVPKGDKGDKGETGAKGADATPLTVTGETKDGNGNTVVNFSDGSHATISKGDKGDTGAKGETGDSVTIKSITPQPNGDTKVVFSDGKEVNIPKGAKGDKGDTGSTGANGQDAAPLTVTSTNKDGDGNTVIHFSDGQTATVSKGDKGDTGATGAAGKDAAPLTVTSTTKDNDGNTVVHFSDNSTATISKGDKGDAGQTGATGAKGDKGQDAQPLTVTSTNKDGDGNTVIHFSDGQTATISKGDKGDKGNTGATGANGQDGQSVTITSTTTEPNGDTKVTFSDGHIITIPKGKDGKSVTVESSAPDKDGNTVVHFSDGSNATISKGDKGDRGETGAAGKDATPLTVTSTDKDKDGNTVIHFSDGQTATVSKGEKGDTGATGAAGRDGQSITIASIEPQDNGDTKVTFSDGQSINVPKGKDGKSVTITNTETLPNGNKQVTFSDGKTLEIPKGDKGEQGEDGAKGDKGENGASITIDRTEETPEGTKVTFSDGKSITIPKGKDGKSITVKSSEPNADGDIVVTFSDDSQITIPKGAKGDQGAAGPAGRDGVSITITNTETTPEGNTKVTFSDGHSITINKGEKGDTGTVGTDGTSVTITSSKVLDNGDNEVTFSDGTKITIPKGAKGDKGDVGDSITVQSTQPLANGDVEVTFSDGKKVTIPKGAKGDKGDAGAKGADATPLTVQSTDKDQDGNTVIHFSDGGTATISKGDKGDAGEKGADGSSVTVDQINKLPNGDSEVVFSDGKKVTIPKGEKGDTGQNAQPLTVTGSEKDAEGNTVIHFSDGTSATVSKGDKGEQGLQGLQGEAGVKGDKGDSITITSVTPQDNGDTKVVFSDGRGLTIPKGAKGDKGDAGAKGADATPLTVTGSEKDADGNTIVHFSDNSQAIISKGDKGEAGENGQSITVQNVAPDKDGNTVVTFSDGSKVIIPKAKDGVNGQDGQSITVQGTETTPEGNTKVTFSDGTSITIAKGEKGDKGEAGKDAAPLTVTGTSQDPDGNTVLDFSDGSHATVAKGKDGAAGQDGKSISITDTAVQPDGSTKLTFSDGHEVIIPKGAKGDKGDTGAQGAAGQDGTSVTITSTETTPEGATKVNFSDGKSITIPKGQDGTSVTVQSSAPDADGNTVVTFSDGKTVTIPKGVKGDKGDTGAQGEKGADAAPLTVTGSPQTPEGNTEVTFSDGSKVVIPKAKDGVNGQDGKSVTVTGSEVQPDGSTKVTFSDGHEIVIPKGEKGDKGDAGQNGQSITVESSNPDADGNTVVNFSDGSKVVIPKAKDGAAGKDGKSITVQSTEKTPEGDTKVTFSDGTSVTIAKGDTGATGAAGQTGADGKSITVQSVQPDADGNTEVTFSDGSKVVIPKAKDGVNGQDGKSVTVTGSEVQPDGSTKVTFSDGHEIVIPKGEKVDTGATGATGQNGQDGKSITVAKVEPQPNGDTKVTFSDGKEITIPKGAQGEAGQNGADAQPLTVTGSVQKPDGNTEVTFSDGTKVVIPKGEKGEKGEKGDTGSAGQSITVQSTEKTPEGDTKVTFSDGTSVTIAKGDTGATGAAGQNGQDGQSITVAKVEPQPNGDTKVTFSDGKEVTIPKGEKGDKGDTGANGVDGRSITVQSSEVQPDGSTKVTFSDGHEVTIPKAQDGKSITIDKTEPDADGNIVVTFSDGSSVTIPKGAKGDTGAQGEAGQNGADAQPLTITGSTQTPDGNTEVTFSDGSKVVIPKAKDGVDGHSITVQGTEKTPEGDTKVTFSDGTSVTIAKGDTGATGAAGQSITVQSTEKTPEGDTKVTFSDGTSVTIAKGEKGDKGDSVTVAKVEPQPNGDTKVTFSDGKEVTIPKGDKGDTGAQGAAGQNGADAKPLTVTGSTQTPAGDTEVTFSDGTKVTIPKAKDGKSITVQNTAPDADGNTVVTFSDGSAITIPKGAKGDKGETGTPGTSVTVAKVEPQPNGDTKVTFSDGKEVTIPKGEKGDKGDTGAQGATGQNGRDGQSITVQSTAPDADGNTVVTFSDGSKVVLPKGKDGVDGKSVTVQNTETTPEGNTKVTFSDGHEITIAKGDKGDKGDSVTVAKVEPQPNGDTKVTFSDGKEVTIPKGEKGDKGDTGAQGAAGQNGADAKPLTVTASTQTPEGNTEITFSDGTKVTVPKAKDGKSITVQSTAPDADGNTVVTFSDGSAITIPKGAKGDAGKDGIDGKDAKPLTVTSTEKDADGNTVIHFSDGGTAVISKGDKGAGGQSITVQNVGPDADGNTEVTFSDGSKVTIPKAKDGIDGKSITITGNETLPSGDIKVTFSDGHEIIVPKGTKGDAGDSVTIVKTTKDPNGNTVVSFSDGSSVTIPKGDKGDKGDDGTSVTITGTEVQLDGSTKVTFSDGREINIPKGKDGKSVTITKAEPDADGNTVIDFSDGSKVTVPKGKDGKSITVPKGQDGRSVSVKGSHLDKDGNTVVEFTDGNVITVLKGRDGKDGVDGKSITVTGQKVDPNGNTIVVFSDGREITIPKGKDGISVTVKNSHPDKDGNTIVEFSDGNTITVLKGQDGRDGLNGRDGRDAQPYTPVIIVNNYIDAYNTHVVCLSDGRKIEIPCCPNGQPVIIVGYYYDTVGNIVLQCGDNSRVIVPCQKSIQPSVSIPMIPLVPAQPSVPVQPSVPAQPSVPAQPSVPVQPSVPVQPSVPVDPNGQIETPNIPGPQTPKEPTQPGGYTPFVPNNSGDQFVPEQPNTDTKVPSVEKDNNEGNHVTDENRGYTTRKTNTDIKVEKANKTKSAQPQQKVKALPNTGSDNTAPMLYGTIFAGLGTAMVFGMKRRKNK

SEQ ID NO: 41904 - protein, 482 aa, Staphylococcus carnosus
  strain TM300
MKKKQLFSLRKLSVGIASVSLGTLVFLGGAQAANAEDAATTQADKDAQAVNAQVELAKKAGAELEAKDNTQKQVETAQNVSKEQVDKAQAEINALNGISKETKDIYNKKVADAATADIPGIVQDAKAVNAQVELAQNAAKEQEAQAKAARELNTLTQVAYNTVNNLHNLTDQQKDAFNQQILNDSGNNNGQNINAIVENAKQLDTNNRNEKHAREAGANTVEKKEAKDLETLTTVAIDQVNGLHNLTDQQKEAFVKQIKNDSTNNKGQNLKGIVTNARQLDTNNGNEKHAREAGANTGLSQDVAEKVKKAHNEVDALKNSTPEQKAAAHSKLNDDARNNVNGIDKVVKDAKALDAKQAPKKDPKNQNVTTTKEKTPKNQETKNQGTTKQGPAATTGNGKVAQAQPGKDQTAKVTTEQKTGQNLAQAKVTKDEAKAQQKAEAAKKQLPETGEQDQVLFGMLAGTLFASAGTLFLVQARRKENE

SEQ ID NO: 41905 - protein, 60 aa, Staphylococcus carnosus
  strain TM300
MIRGIGRESTPQVVRNEAEALPETGETDNVPTASLFGTLFAVLGSIFLFWRRRKEEDEEQ

SEQ ID NO: 41906 - protein, 448 aa, Staphylococcus carnosus
  strain TM300
MKRNNLSRNRYAIRKYTVGTASALVASVAFLTVSHSADAAEQNGENNVEAISKAQVQTANSFQPETSLQNTSQTPESDNLNQSPSQNVLQSNHQPSKSLTSQQPTSLEMQNTTKESTQNETSVKAPKSNTASEEQTQNSVPAPKAPEKDSISPSATEKTTEQQTEQPAPEVQVAPGVLTPAQGQIAEKGTEIEDTATKKPQPIEPAQNDKKREEPITEKATKQQKEQPAPEVQVAPEVLTPAQGQIAEKGTEIEDTATKKPQPIEPSHKTESIEPSIIEEPVTKQAETIQPAEKNADESSQSKAASESTSSEKTIPTTDAAASTDSSKNTSTESSTEKEAVAGSQNVIKDVPEKSAHVTTTSTPGNPLEKPQPQKNQQPQSSTPANTTASQRTSSQTDGQSTTKEAKAAQEQAINKYPVIFVHGFMGFVGDIKPDLYPNYWGGDKYHL

SEQ ID NO: 41907 - protein, 158 aa, Staphylococcus carnosus
  strain TM300
INTLWEWSYAAVGTVQQPVQSTSKAVSVQKQAAPVAQQTQTYNTQQTQSYNNANYSYNTQSTSYTAPRQSYTASNSGSYGNIPAALQAIVYRESRGDIHAINPDSGAAGKYQFLQSTWDAVAPAGWRGVNPASAPEYIQDQAALTLWDNGNGAGHWAY

SEQ ID NO: 41908 - protein, 254 aa, Staphylococcus carnosus
  strain TM300
MKKTAIIKASLASLVIGTGLFASTAQASEISLVRHTLGLDQQSKQTQQNTNVYKTDREDKNVLLGYYTQPSTELTNLIGYTKDNDKLEFVPKGGVGETLVTVSPNTFSKYNADNKGNPGLDVFVVRENTSDRSASILSKGGVTKTNKNQYKDTLKTPIINVKSTENGLTKDESLKGINFNKEEVSLKEVDFKLRKALIEQKGLYKGQYSDGKIIVHLNDGEHNTFELHKKLQDNRMSDVINSTDIKYIEVSLTK

SEQ ID NO: 41909 - protein, 1384 aa, Staphylococcus carnosus
  strain TM300
MKKLDFLPNLKNKYSIRKFTVGTASILLGSLLFLGQNDAQAAEETSEKAVAEVANDSTEGQTFPQPENEITQETPPQLTKENENSTLENNINDVKSENDLKLNKEVPETSTSTTETRQGIENVPALNEEQKESNVKPTSEQQNGIDTNQQPTAEAVESEANNPPVLATESNSKHNEDTDNSAESLTTEQKVEKVKAELITQHDNSEIDQSLAVIDTDGLTSEEIKAEVVKLLFNRETAEKDLYKPQATLPRKEDESPKFAVRAVPKDKSELEKAITDGQNITNLDPNKQIDQNLIDALAEAKNVDNDLNADQQATDDSKNKLNTAIQEKLRQDAVEKLIAVAERGSKLEEAEYYTPKTAQNLKDLVDKYNALVVASTSNDPVERVRHSIQEIEEAVKEINDGIDQLERKPDKTELEAALDKAVAFDNLDMNDPEDKAVDDALKAGQDVEGDLNATTAQVEKVSKDLNDALDAKAKQDALDAAAKDKQAAFDELNKAVDAAQKIEQAEFTPESVKPLETAKEAGKQLAADNAATPEQLKGATKLIQDAINQLVTDKSELTKQIEAAQALEPLNNSATDQILKNTLDAAIAVKNDPNANPQAIKEATWNLEDEINNKIAADAIEALRTAVNKVNAADEPAYTPNSFAPLKVAAVEGQSILDDPSSASLPETIAKAKEINQFIDGLKEKADKTELEKALDAAVAFDNLDMNDPEDKAVDDALKAGQNVEGDLNATPEQVKKAADVLNEALDAKKAQDAKDTDAKTKQAALDELNKAIEAAKAVTKSDYTPNTVTPLEKAVKAGETAKADTNKTPEELKQAAKAINDAKDALKAKADKTELEKALDKAVAFDDLDLNDPEDKAVDDALKAGQEVEGDLNATPEQVKQAADVLNEALDAKKAQDAKDADEKAKQDAKDVDEKTKQAALDELNKAIEAAKAVNKADYTPNTVTPLDNAVKAGVTAKADTNKTPEELKQAAKAINDAKDALKAKAEQDTKDAAEKVNQENKVDKTELSKSIAKAESINFFDPGDKEDAAVLDALSNAKEVEADTNALQSDVDKTKDVLEKALSAKAEQDAKDAAEKVEQDNKVDKTELNKSIAKAESINFFDPGDKEDAAVLDALSNAIEAAANPNISQTKVNETVAALNSAIATKNAQDTKDAAEAAKVKQEVLDTDETQEEIIDEEIIQPNNEDPIVDEKVDSTVVDEPTIKPVEERQKPSEVSKDKLAELQKVITIAEKTHTTEYTQQSVEALEKAVKNGKSIVENSDGFTIEEIQNALQTIEDAIHNLEVKESTTIPPAEKVAESKLTSNVENVDSNSTVKSTVKQNHTVTKEVNHKAENSKEKVLPKTGENLAPVHPIYATLMFAIGGLMMFFRKRKNEDKDSTEK

SEQ ID NO: 41910 - protein, 232 aa, Staphylococcus carnosus
  strain TM300
MKKLLVASSASAALFAVGVGANAHAAEDNNVNQDQLAQTALNNTQQLNDAPVQEGAYNIAFDNSGYNFNFNSDGTNWSWSYNADSSAQQAPAQSTTQEQAPAAQQAPAQSTTQEQAPAAQQAPAQEQTQQPAQQPAQQQTQQPAQQSADSGSNVQVNDHLKAIAQRESGGDIHAINSSSGAAGKYQFLQTTWDSVAPAEYQGKPASEAPEAVQDAAAQKLYDTAGPSQWVTA

SEQ ID NO: 41911 - protein, 1530 aa, Staphylococcus chromogenes
MGNKQGFLPNKLNKYSIRKFTVGTASLLVGATLVFGIGSEAQAAELDTITKEDVKSQDKGEALDIKNIKKSEKDVTTEDDNNAQVQNSAQTVDKSENSNDIAVESTNDSVKTDETKETSENKSAQDDDNIKEDSNTQEASTNTSSQSSEDPQTKKEQPDKSSNSIKEPDKQQEEVAKEEKATTEIADKNKELELKNNKTDKNEESELESNLSSSENKKDTVESFLNSQLSDSGTKKIMENANIDYDKATDEEINTEILRASLIEMANNKKKTETLATPQRTMFRAMATPTALRAAVNQDEELQKSLGYTDNYTFASMLFDPGKLDSDDALNSNIIPFDLHSYMSGANSGNRYKIDLKLDPIIAEHVTKISANPSGSNKPVEFVRIKDENGNLTDTWEVNFIRANDGLFGGAEILSQYTAKNGKIELDDTVGNIISSAGDLSNNKLNYQVFVRDSRENKIVRTSESSGYFLTKADDDLVNLENNVSTENNNAFKASSGSATYNEDVGEFGGILIDQQIMKNGIFSYSKTKANQWAYNYQIDKDLLPYIEGVELHQYDYKGLNGFDKNYDAKNKVADLTIDEVGNGTITSDNLNKLIEFNNALPETVGVRVVLKLNQSVNNILTKDAKYDSEGNLIRETTKQKEDFTFAGYLTDSKGALINNTLGTSTLALQDYDKDGLLDRYERQLSLSDAENEDTDGDGKNDGDEVVNYKTSPLVGKPQAADITTEDTVVSGSVPLKEGAATQTAKVTNAEGTTVGTATVNSDGTFSVSIPNSPEGTYTIAIDSPNYDNDEVNIFEIVDNSKLPAPSINPVDDNDQQIVVNGTSGSTVTVTDSNNNVLGTVTIPADDTSAAINVDTPLEAGTVLTSTASKDGKTSDVSDQITVTDATAPDAPTVNDVTSDATQVTGQAEPGSTVTVTFPDGTTATGTADDQGNYTINIPSNVDLNGGEELQVTATDKDGNTSEPSSANVTDTTAPDAPTVNDVTSDATQVTGQAEPGSTVTVTFPDGTTATGTADDQGNYTINIPSNVDLNGGEELQVTATDKDGNTSEPSSANVTDTTAPDAPTVNDVTSDATQVTGQAEPGSTVTVTFPDGTTATGTADDQGNYTINIPSNVDLNGGEELQVTATDKDGNTSEPSSANVTDTTAPDAPTVNDVTSDATQVTGQAEPGSTVTVTFPDGTTATGTADDQGNYTINIPSNVDLNGGEELQVTATDKDGNTSEPSSANVTDTTAPDAPTVNDVTSDATQVTGQAEPGSTVTVTFPDGTTATGTADDQGNYTINIPSNVDLNGGEELQVTATDKDGNTSEPSSANVTDTTALDAPTVNDVTSDATQVTGQAEPGSPVTVTFPDGTTATGTADDQGNYTINIPSNVDLNGGEELQVTATDKDGNTSESTNTTIIDSDDNSDNGNNSGAGDNSDSDSNSGNGDNSDTADNSDSDNNSDSGDNSNAGDNSDSNNNSNSEDNSSPNKDSINQDSNINSNDSKHDKQNELPETGEKEVSNGTLFGTLFAGLGSLLLFTKRRRKENDKK

SEQ ID NO: 41912 - protein, 155 aa, Staphylococcus cohnii
MINKINKKTIAIIIIIGLIALLFTFFKSHTTKLSKDDAIEMDGYKISYNENPGEYQGQLRIPMRVENLKNIDNPINPDKTFKLIADGKEAEMESFSNDSKYVNGTSFSPRMTVSLDIVYKIKGNPKSYKLQIHDRKLLKDKVYEYDITSDISKVN

SEQ ID NO: 41913 - protein, 43 aa, Staphylococcus cohnii
  subsp. cohnii
MSGIVEAISNAVKSGLDHDWVNMGTSIADVVAKGADFIAGFFS

SEQ ID NO: 41914 - protein, 18 aa, Staphylococcus cohnii
  subsp. cohnii
MDFIIDIIKKIVGLFTGK

SEQ ID NO: 41915 - protein, 43 aa, Staphylococcus cohnii
  subsp. cohnii
MSDFVNAISEAVKAGLSADWVTMGTSIADALAKGADFILGFFN

SEQ ID NO: 41916 - protein, 43 aa, Staphylococcus cohnii; identical to SEQ ID NO: 41913
  subsp. urealyticus

SEQ ID NO: 41917 - protein, 18 aa, Staphylococcus cohnii
  subsp. urealyticus
MDFIIDIIKKIVGLFTGK

SEQ ID NO: 41918 - protein, 43 aa, Staphylococcus cohnii; identical to SEQ ID NO: 41915
  subsp. urealyticus

SEQ ID NO: 41919 - protein, 643 aa, Staphylococcus epidermidis
MKNNNETRRFSIRKYTVGVVSIITGITIFVSGQHAQAAEMTQSSSDFNEQSQQTEQVEHKEDTTHLSYELNQEGDTASQSKTNQENQSDENVQKKNNQTQQDSTQTSPLNDQEQTLKGQQSKDNHVTPNSRQDTYPKGQNQDDKGKQQFKDNQHSQTEHQPNTQNQNNDQDSSDKKQHPSDQTQAPSSKGTQPKQSQSIGDRDKTVKQPSSKVHKIGNTKTDKTVKTNQKKQTSLTSPRVVKSKQTKHINQLTAQAQYKNQYPVVFVHGFVGLVGEDSFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQKPNESYAEYAKRIANSKVWETEDQAVNDLTTAGAEKLNQMTTLNPNIVYTSYTGAATHTGPLGNEVPNIRQFPLFDLTSRAIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 41920 - protein, 1348 aa, Staphylococcus epidermidis
MSASDSTSVSASDSTSTSASDSASTSASDSASLSTSASDSASTSASDSASTSASDSASVSASDSASTSASDSASVSASDSASVSASDSASLSTSVSDSNSMSASDSTSVSASDSASTSASDSTSVSASDSTSVSASDSASVSASDSASLSTSVSDSNSMSASDSTSVSASDSASTSASDSTSVSASDSTSTSASDSASTSASDSASLSTSASDSASTSASDSASVSASDSASVSASDSASVSASDSASLSTSVSDSNSMSASDSTSVSASDSASTSASDSTSVSASDSTSVSASDSTSVSASDSASVSASDSTSTSASDSASTSTSDSASTSASDSASTSTSDSTSTSASDSASVSASDSASVSASDSASLSTSVSDSNSMSASDSTSVSASDSASTSTSDSTSVSASDSASTSASDSASVSASDSASLSTSVSDSNSMSASDSTSVSASDSASTSTSDSTSVSASDSASVSASDSTSTSASDSASTSASDSTSVSASDSTSTSASDSASTSTSDSASTSASDSASTSASDSTSVSASDSTSTSASDSASTSASDSTSVSASDSASVSASDSTSTSASDSASTSTSDSASTSASDSASTSTSDSTSTSASDSASVSASDSASVSASDSASLSTSVSDSNSMSASDSTSVSASDSASTSTSDSTSVSASDSASTSASDSASVSASDSASLSTSVSDSTSVSASDSTSTSVSDSNSMSASDSTSVSASDSASTSASDSASTSASDSTSVSASDSTSTSASDSASTSTSDSASTSASDSASTSASDSTSVSASDSTSTSASDSASTSASDSTSVSASDSASVSASDSTSTSASDSASTSASDSASLSTSASDSASTSASDSASVSASDSASLSTSVSDSNSMSASDSTSVSASDSASTSASDSTSVSASDSTSVSASDSTSVSASDSASVSASDSTSTSASDSASTSTSDSTSTSASDSASVSASDSASVSASDSASLSTSVSDSNSMSASDSTSVSASDSTSTSASDSASTSASDSASLSTSASDSASTSASDSASTSASDSASTSASDSASVSASDSASTSASDSASVSASDSASVSASDSASLSTSASDSASTSASDSASVSASDSASTSASDSASTSASDSASLSTSASDSASTSASDSASVSASDSASTSTSDSASVSASDSASTSASDSASVSASDSASVSASDSASLSTSVSDSNSMSASDSTSVSASDSASTSASDSASTSASDSASLSTSASDSASTSASDSASVSASDSASTSTSDSASVSASNVTSNATSNSASTGESTNSSNVVQQSNHKDNSDENKELPETGNSNDANNTNVLMGAVLSLLAGLGLMKRSRKNKEDKK

SEQ ID NO: 41921 - protein, 172 aa, Staphylococcus epidermidis; identical to SEQ ID NO: 30248

SEQ ID NO: 41922 - protein, 411 aa, Staphylococcus epidermidis
MKQIIEKVQAMEIFDSRGNPTVEVTVELSDGTTGIAAVPSGASTGNSEALELRDGDKRLEGKGVQQAIKNINFDINELLNNHSPFNQKHIDQLMINSDGTENKSKYGANAILGTSMAVARAAANALKLPLYRYLGGIDLSFPKLFFNVINGGAHADSGVDIQEFLITPISNSTLKKGIEMIANTYHALKIILKEQNLSNAVGDEGGFAPSLNSSEEAFQLLIEGIKRAGYNPGKDIAIAIDPAASEFYQNSFYEFEGAKYTSSQMIEYYQYLIEKYPIISIEDGLAEDDWEGFARMTEILGNSIEIIGDDIFVTNPTIFKKGISQEIGNAILIKLNQIGTVSETIETINIARKNNYKIMISHRSGETVDSFISDFAVAMNADQMKSGSMARSERVEKYNQLLRIEKELEII

SEQ ID NO: 41923 - protein, 1211 aa, Staphylococcus epidermidis
MKKSKKRLDFLPNKLNKYSIRRFSVGTASILVGATLLFGINNEAHAAEQNETQSVSQEATNDDSTSEAPQETPAKEEATNNDSTSEAPQETPAKEEATNNDSTSEAPQETPAKEEATNNDSTSEAPQETPAKEEATNNDSTSEAPQETPAKEEATNDDSTSEAPQETPAKEEATNDDSTSEAPQETPAKEEATNDDSTSEAPQETPAKEEATNNDSTSEAPQETPAKEEATNDDSTSEAPQETPAKEEATNNDSTSEAPQETPAKEEATNDDSTSEAPDYVGVNSDSLENSTLENGDDESSNDQDKDIAYATPAEATAPRSIQPRSRVALNEAQAQKQGKNVNDLITVTNQSITEGGREDGIISAHDGENITYTTDFKIDNDVKSGDTMTVKYDPRTVPSDLTDDHTPVDIMDPSGEVIATGSFDNTNKTSTYTFTDYVDKYENVNAKLVMNSFIDKKEVPNEETVDLTFATANEPINKTFNVSYQRPIVERASNIQSIFTHLDLDDNTVEQTVYVNPLSLNAQNAKVLIRGAGVYDDGGFFNGEGSTIIDNSTDIKVYKAKPGQKLPQSNRIYDYSQYEDVTNQVNIDKNYSNNQAMVDFGNINSPYIIKVESKYTPGAEDSLAIQQGVRMTTTNDGILSYAGYTNSIISTNDQGGGNGEEAPEQTYKIGDYVWEDVDKDGVQGTDEKEKPISNVLVTLTYPDGTSKSVRTDENGHYEFDNLYDGETYQVSFETPEGYEPTKVNAGNNSELDSNGSNVSVTINGSDDMTLDSGFYKTPKYSIGDYVWLDSNKDGVQDEEESGISGVTVTLKDKDGKTLQTTQTDEKGKYRFDNLDSGDYKVVFEKPEGLTQTSTNSTNEDEDADGEEVDVTITDHDDFSIDNGYFEDDTDADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADADNEKLPDTGNNSHNGTLFGSLFAALGALLLGKRRKNDNKEQ

SEQ ID NO: 41924 - protein, 25 aa, Staphylococcus epidermidis
MTADIISTIGDFVKWILDTVKKFAK

SEQ ID NO: 41925 - protein, 2455 aa, Staphylococcus epidermidis
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAEEGGNAEAPQSEPTKAEEGGNAEAPQSEPTKAEEGGNAEAPQSEPTKAEEGGNAEAAQSEPTKTEEGSNVKAAQSEPTKAEEGSNAEAPQSEPTKTEEGSNAQAAQSEPTKAEEGGNAEAAQSEPTKTEEGSNAEAPQSEPTKTEEGGNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPVDGDPITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGTPAEPGKPAEPGTPAEPGKPAEPGKPAEPGKPAEPGTPAEPGKPAEPGTPAEPGKPAEPGKPAEPGKPAEPGTPAEPGTPAEPGKPAEPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 41926 - protein, 688 aa, Staphylococcus epidermidis
MKTRQNKYSIRKFSVGASSILIAALLFMGGGSAQAAEQQQDKGTVENSTTQSIGDENEKLSEQQSTQNKNVNEKSNVNSITENENLHNETPKNEDLIQQQKDSQNDNKSESVVEQNKKNEAFVQNHSEEKPQQEQVELEKHASENNQTLHSNAAQSNEDVKTKPSQLDNTTAQQKDSQKENLSKQDTQSSKNTDLLRATGQNQSKDSQSTEEVNKEVNNDTQQVTAKKDDDKVETFNLNSKEEPLKVDKQANPTTDKDKSSKNDKGSQDGLANLESNAVATTNKQSKQQVSEKNEDQTNKSAKQKQYKNNDPIILVHGFNGFTDNINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLVYDVGKMYGNKDSRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 41927 - protein, 1335 aa, Staphylococcus epidermidis
MAKKFNYKLPSMVALTLFGTAFTAHQANAAEQPQNQSNHKNVLDDQTALKQAEKAKSEVTQSTTNVSGTQTYQDPTQVQPKQDTQSTTYDASLDEMSTYNEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYNFDYDDEDDDSSTDHLEPISLNNVNATSKQTTSYKYKEPAQRVTTNTVKKETASNQATIDTKQFTPFSATAQPRTVYSVSSQKTSSLPKYTPKVNSSINNYIRKKNMKAPRIEEDYTSYFPKYGYRNGVGRPEGIVVHDTANDNSTIDGEIAFMKRNYTNAFVHAFVDGNRIIETAPTDYLSWGAGPYGNQRFINVEIVHTHDYDSFARSMNNYADYAATQLQYYNLKPDSAENDGRGTVWTHAAISNFLGGTDHADPHQYLRSHNYSYAELYDLIYEKYLIKTKQVAPWGTTSTKPSQPSKPSGGTNNKLTVSANRGVAQIKPTNNGLYTTVYDSKGHKTDQVQKTLSVTKTATLGNNKFYLVEDYNSGKKYGWVKQGDVVYNTAKAPVKVNQTYNVKAGSTLYTVPWGTPKQVASKVSGTGNQTFKATKQQQIDKATYLYGTVNGKSGWISKYYLTTASKPSNPTKPSTNNQLTVTNNSGVAQINAKNSGLYTTVYDTKGKTTNQIQRTLSVTKAATLGDKKFYLVGDYNTGTNYGWVKQDEVIYNTAKSPVKINQTYNVKPGVKLHTVPWGTYNQVAGTVSGKGDQTFKATKQQQIDKATYLYGTVNGKSGWISKYYLTAPSKVQALSTQSTPAPKQVKPSTQTVNQIAQVKANNSGIRASVYDKTAKSGTKYANRTFLINKQRTQGNNTYVLLQDGTSNTPLGWVNINDVTTQNIGKQTQSIGKYSVKPTNNGLYSIAWGTKNQQLLAPNTLANQAFNASKAVYVGKDLYLYGTVNNRTGWIAAKDLIQNSTDAQSTPYNYTFVINNSKSYFYMDPTKANRYSLKPYYEQTFTVIKQKNINGVKWYYGQLLDGKYVWIKSTDLVKEKIKYAYTGMTLNNAINIQSRLKYKPQVQNEPLKWSNANYSQIKNAMDTKRLANDSSLKYQFLRLDQPQYLSAQALNKLLKGKGVLENQGAAFSQAARKYGLNEIYLISHALVETGNGTSQLAKGGDVSKGKFTTKTGHKYHNVFGIGAFDNNALVDGIKYAKNAGWTSVSKAIIGGAKFIGNSYVKAGQNTLYKMRWNPANPGTHQYATDINWANVNAQVLKQFYDKIGEVGKYFEIPTYK

SEQ ID NO: 41928 - protein, 26 aa, Staphylococcus epidermidis
MMAADIISTIGDLVKWIIDTVNKFKK

SEQ ID NO: 41929 - protein, 688 aa, Staphylococcus epidermidis
MKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTAQQEDSQKENLSKQDTQSSKTTDLLRATGQNQSKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 41930 - protein, 1092 aa, Staphylococcus epidermidis
MINKKNNLLTKKKPIANKSNKYAIRKFTVGTASIVIGATLLFGLGHNEAKAEENSVQDVKDSNTDDELSDSNDQSSDEEKNDVINNNQSINTDDNNQIIKKEETNNYDGIEKRSEDRTESTTNVDENEATFLQKTPQDNTHLTEEEVKESSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSVSDSDSDSDSDSGSDSDSDSDSDSDNDSDLGNSSDKSTKDKLPDTGANEDYGSKGTLLGTLFAGLGALLLGKRRKNRKNKN

SEQ ID NO: 41931 - protein, 174 aa, Staphylococcus epidermidis
MYAEYVNQLKNFRIRETQGYNSWCAGYTMSALLNATYNTNRYNAESVMRYLHPNLRGHDFQFTGLTSNEMLRFGRSQGRNTQYLNRMTSYNEVDQLTTNNQGIAVLGKRVESSDGIHAGHAMAVAGNAKVNNGQKVILIWNPWDNGLMTQDAHSNIIPVSNGDHYEWYASIYGY

SEQ ID NO: 41932 - protein, 282 aa, Staphylococcus epidermidis
MKKRFLSICTMTIAALATTTMVNTSYAKTDTESHNHSSLGTENKNVLDINSSSHNIKPSQNKSYPSVILPNNNRHQIFNTTQGHYDAVSFIYIPIDGGYMSGSGVVVGENEILTNKHVVNGAKGNPRNISVHPSAKNENDYPNGKFVGQEIIPYPGNSDLAILRVSPNEHNQHIGQVVKPATISSNTDTRINENITVTGYPGDKPLATMWESVGKVVYIGGEELRYDLSTVGGNSGSPVFNGKNQVIGIHYGGVDNKYNSSVYINDFVQQFLRNNIPDINIQ

SEQ ID NO: 41933 - protein, 507 aa, Staphylococcus epidermidis
MKNFSKFALTSIAALTVASPLVNTEVDAKDKVSATQNIDAKVTQESQATDALKELPKSENIKKHYKDYKVTDTEKDNKGFTHYTLQPKVGNTYAPDKEVKVHTNKEGKVVLVNGDTDAKKVQPTNKVSISKESATDKAFEAIKIDRQKAKNLKSDVIKTNKVEIDGEKNKYVYNIEIITTSPKISHWNVKIDAETGQVVDKLNMIKEAATTGTGKGVLGDTKQININSVSGGYALQDLTQQGTLSAYNYDANTGQAYLMQDKDRNFDDDEQRAGVDANYYAKETYDYYKNTFGRESYDNQGSPIISLAHVNNFQGQDNRNNAAWIGDKMIYGDGDGRTFTALSGANDVVAHEITHGVTQQTANLVYRSQSGALNESFSDVFGYFVDDEDFLMGEDVYTPGVGGDALRSMSNPERFGQPSHMNDFVYTNSDNGGVHTNSGIPNKAAYNTIRSIGKQRSEQIYYRALTVYLTSNSDFQDAKASLQQAALDLYGEGIAQQVGQAWDSVGV

SEQ ID NO: 41934 - protein, 688 aa, Staphylococcus epidermidis
MKTRQNKYSIRKFSVGASSILIAALLFMGGGSAQAAEQQQDKGTVENSTTQSIGDGNEKLSEQQSTQNKNVNEKSNVNSITENESLHNETPKNEDLIQQQKDSQNDNKSESVVEQNKENGAFVQNHSEEKPQQEQVELEKHASENNQTLHSKAAQSNEDVKTKPSQLDNTAAKQEDSQKENLSKQDTQSSKTTDLLRATAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 41935 - protein, 2742 aa, Staphylococcus epidermidis
MGNKQGFLPNKLNKYSIRKFTVGTASLLVGATLVFGIGSEAQAAELDTITKGDVKSQDKGEALDLKNIKESEKDVTTEDDNNAQVQNSAQTVDKSENSNDTAVESTNDSVKTDETKETSENKSAQDGDNIKEDSNTQEESTNTSLQSSEVPQTKKDTDETSETAIDEDAYTKEQNNKDNDTAQDDDNIKEDSNTQEESTNTSSQYSEDSQTKKEQPDKSSNSIKEPDKQQEEVAKEEKATTEIADKNKELELKNNKTDKNEESELESNLSSSENKKDTVESFLNSQLSDPETKKIMENANIDYDKATDEEINTEILRASLIEMANKKKKTETLATPQRTMFRAMATPTALRAAVNQDEELQKSLGYTDNYTFASMLFDPGKLDSDDALNSNIIPFDLHSYMSGSNSGNRYKIDLKLDPIIAEHVTKISANPSGSNKPVEFVRIKDENGNLTDTWEVNFIRANDGLFGGAEILSQYTAKNGKIELDDTVGNIVSNAGNLSNNKLNYQVFVRDSKENKIVRTSESSGYFLTKADDDLVNLENNVSTENNNAFKASSGSATYNKDVGEFGGILIDQQIMKNGIFSYSKTKANQWSYNYQIDKDLLPYIEGVELHQYDYKGLEGFDKNYDAKNKVADLTIDEVGNGTITSDNLNKLIEFNNALPETVGVRVVLKLNQSVNNILTKDAKYDSEGNLIRETTKQKEDFTFAGYLTDSKGALINNTLGTSTLALQDYDKDGLLDRYERQVSLSDAESEDTDGDGKNDGDEVINYKTSPLVGKPQAADITTEDTVVSGSVPLKEGAATQTAKVINAEGTTVGTTTVNSDGTFSVSIPNSPEGTYTIAIDSPNYDNDEVNTFEIVDSSKLPAPSINPVDDNDQQIVVNGTSGSTVTVTDSNNNVLGTVTIPADDTSAAINVDTPLEAGTVLTSTASKDGKTSDVSDQITVTDATAPDAPTLDEVNTDATQVTGQAEPGSTVTVALPGGGKASTTADDAGNFIVDIPSEVNLEGGETFTATATDETGNESEPSTTTVVDTTAPDAPTVNDVTSNDKVINGTAEPNSTVKLTFPDGTTAAGTTDSNGNYTVDIPENMSLKGGETITATSSDAEGNESESATTTVVDATAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSEPSSANVTDTTAPDAPTVNDVTSDATQVTGQAEPNSTVTVTFPDGTTATGTADDQGNYTIDIPSNVDLNGGEKLQVTATDKDGNTSEPSSANVTDTTAPDAPTVNDVTSDATQVTGQAEPNSTVTVTFPDGTTATGTADDQGNYTIDIPSNVDLNGGEEVQVTATDKDGNTSEPSSANVTDTTAPDAPTVNDVTSDATQVTGQAEPNSTVTVTFPDGTTATGTADDQGNYTIDIPSNVDLNGGEELQVTATDKDGNTSESTNTTVIDSDDNSDNGNNSGAGDNSDSDNNSGNGDNSGAGDNSDSDNNSDSGDNSNAGDNSDSDNNSGNGDSSNAGDNSDSDNNSGNGDNSSAGDNSDSDNSSNNEDNSSSNKDSINQDSNVNSNDSKHDKQNELPETGEKEVRNGTLFGTLFAGLGSLLLFTKRRRKKNDKK

SEQ ID NO: 41936 - protein, 289 aa, Staphylococcus epidermidis
MKPFKLIFISALMILIMTNATPISHLNAQANEENKKLKYEKNSALALNYHRVRKKDPLNDFISLLSGSKEIKNYSVTDQEFKSQIQWLKAHDAKFLTLKEFIKYKEKGKFPKRSVWINFDDMDQTIYDNAFPVLKKYHIPATGFLITNHIGSTNFHNLNLLSKKQLDEMYETGLWDFESHTHDLHALKKGNKSKFLDSSQSVASKDIKKSEHYLNKNYPKNERALAYPYGLINDDKIKAMKKNGIQYGFTLQEKAVTPDADNYRIPRILVSNDAFETLIKEWDGFDEEK

SEQ ID NO: 41937 - protein, 1477 aa, Staphylococcus epidermidis
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAEEGGNAEAPQSEPTKAEEGGNAEAAQSEPTKTEEGSNVKAAQSEPTKAEEGSNAEAPQSEPTKTEEGSNAKAAQSEPTKAEEGGNAEAAQSEPTKTEEGSNAEAPQSEPTKAEEGGYAEAPQSEPTKTEEGGNAEAPNVPTIKANSDNDTQTQFSEAPTRNDLARKEDIPAVSKNEELQSSQPNTDSKIEHTTSEPVNLNYSSPFMSLLSMPADSSSNNTKNTIDIPPTTVKGRDNYDFYGRVDIESNPTDLNATNLTRYNYGQPPGTTTAGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGKSTEKVTKQPVDEIVEYGGGEEIKPGHKDEFDPNAPKGSQTTQPGKPGVKNPDTGEVVTPPVDDVTKYGPVDGDPITSEEIPFDKKREFNPDLKPGEERVIQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGKPAEPGKPAEPGKPAEPGTPAEPGTPAEPGKPAEPGTPAEPGKPAEPGTPAEPGKPAESGKPVEPGKPVEPGTPAQSGAPEQPNRSMHSTDNKNQSPDTGENRQANEGTLVGSLLAIVGSLFIFGRRKKGNEK

SEQ ID NO: 41938 - protein, 1507 aa, Staphylococcus epidermidis
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAEEGGNAEAPQSEPTKAEEGGNAEAAQSEPTKTEEGSNVKAAQSEPTKAEEGSNAEAPQSEPTKTEEGSNAKAAQSEPTKAEEGGNAEAAQSEPTKTEEGSNAEAPQSEPTKAEEGGYAEAPQSEPTKTEEGGNAEAPNVPTIKANSDNDTQTQFSEAPTRNDLARKEDIPAVSKNEELQSSQPNTDSKIEHTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGKSTEKVTKQPVDEIVEYGGGEEIKPGHKDEFDPNAPKGSQTTQPGKPGVKNPDTGEVVTPPVDDVTKYGPVDGDPITSEEIPFDKKREFNPDLKPGEERVIQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGKPAEPGKPAEPGKPAEPGTPAEPGTPAEPGKPAEPGTPAEPGKPAEPGTPAEPGKPAESGKPVEPGKPVEPGTPAQSGAPEQPNRSMHSTDNKNQSPDTGENRQANEGTLVGSLLAIVGSLFIFGRRKKGNEK

SEQ ID NO: 41939 - protein, 25 aa, Staphylococcus epidermidis
MAADIISTIGDLVKWIIDTVNKFKK

SEQ ID NO: 41940 - protein, 2402 aa, Staphylococcus epidermidis
MKNKQGFLPNLLNKYGIRKLSAGTASLLIGATLVFGINGQVKAAETDNIVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLSNDANHQTTDEVNHSDSDNMTNSTPNDTENELDTTQLTSHDESPSPQSDNFTGFTNLMATPLNLRNDNPRINLLAATEDTKPKTYKKPNNSEYSYLLNDLGYDATTVKENSDLRHAGISQSQDNTGSVIKLNLTKWLSLQSDFVNGGKVNLSFAQSDFYTQIESITLNDVKMDTTNNGQNWSAPINGSTVRSGLIGSVTNHDIVITLKNSQTLSSLGYSNNKPVYLTHTWTTNDGAIAEESIQVASITPTLDSKAPNTIQKSDFTAGRMTNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSGQLSNARTSLDRNVFFGTLGQSRSYTISYKLKDGYTLESVASKVSARETFDSWMEVDYLDSYDSGAPNKRLLGSYASSYIDMIDRIPPVAPKANSITTEDTSIKGTAEVDTNINLTFNDGRTLNGKVDSNGNFSIAIPSYYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNVTETIFTIDVEDTTKPTVESIAGQTQEVNTEIEPIKIEAKDNSGQTVTNKVDGLPDGVTFDEATNTISGTPSEVGSYDVTVTTTDESGNSETTTFTIEVKDTTKPTVESVADQTQEVNTEIEPIKIEARDNSGQAVTNKVDGLPDGVTFDEATNTISGTPSEVGSYDITVTTTDESGNVTETTFTIEVEDTTKPTVENVADQTQEVNTEITPITIESEDNSGQTVTNKVDGLPDGVTFDETTNTISGTPSKVGSYDITVTTTDESGNATETTFTIEVEDTTKPTVENVAGQTQEINTEIEPIKIEATDNSGQAVTNKVEGLPAGVTFDEATNTISGTPSEVGSYTVTVTTMDESGNATETTFTIDVEDTTKPTVESVADQTQEVNTEITPITIESEDNSDQAVTNKVDGLPDGVTFDEATNTISGTPSEVGSYTVTVTTTDESGNATETTFTIDVEDTTKPTVKSVSDQTQEVNTEITPIKIEATDNSGQTVTNKVDGLPDGITFDEATNTISGTPSEVGSYDITVTTTDESGNATETTFTINVEDTTKPTVEDIADQTQEVNTEIEPIKIEATDNGGQAVTNKVDGLPDGVTFDEATNTISGTPSEVGSYDIIVTTTDENGNSETTTFTIDVEDTTKPTVESVVDQTQEVNTEITPIKIEATDNSGQAVANKVDGLPNGVTFDETTNTISGTPSEVGSYDIIVTTTDESGNVTETIFTIDVEDTTKPTVESIAGQTQEVNTEIEPIKIEATDNSGQAVTNKVDGLPNGVTFDEATNTISGTPSEVGIYTVTVTTTDESGNATETTFTIDVEDTTKPTVESVADQTQEVNTEITPITIESEDNSGQAVTNKVEGLPAGMTFDETTNTISGTPSEVGSYTVTVTTTDESGNETETTFTIDVEDTTKPTVESIANQTQEVNTEITPIKIEATDNSGQAVTNKVDGLPNGVTFDETTNTISGTPSEVGSYDIKVTTTDESGNATETTFTINVEDTTKPTVESVADQTQEINTEIEPIKIEARDNSGQAVTNKVDGLPDGVTFDEATNTISGTPSEVGSYDITVTTTDESGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPTINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 41941 - protein, 931 aa, Staphylococcus epidermidis
MIKKNNLLTKKKPIANKSNKYAIRKFTVGTASIVIGAALLFGLGHNEAKAEENTVQDVKDSNMDDELSDSNDQSSNEEKNDVINNSQSINTDDDNQIKKEETNSNDAIENRSKDITQSTTNVDENEATFLQKTPQDNTQLKEEVVKEPSSVESSNSSMDTAQQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 41942 - protein, 1733 aa, Staphylococcus epidermidis
MKKRRQGPINKRVDFLSNKVNKYSIRKFTVGTASILVGATLMFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSVSTDSSVNDKQDYTRSAVASLGVDSNETEAITNAVRDNLDLKAASREQINEAIIAEALKKDFSNPDYGVDTPLALNRSQSKNSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGEFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSGQDITVDSNGITTTGIINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDADSDSDSDSDSDADSDSDSDSDSDSDSDSDADSDSDSDSDSDADSDSDSDSDSDSDSDSDSDSDSDSDSDSDSDSDSDSDSDSDSDADSDSDADSDSDSDSDSDADSDSDSDSDSDADSDSDSDSDSDSDSDSDADSDSDSDSDSDSDSDSDSDSDSDSDSDSDADSDSDSDSDSDSDSDSDSDSDSDSDSDSDADSDADSDSDADSDSDADSDSDSDSDSDADSDSDSDSDSDSDSDSDSDSDSDSDSDSDSDSDSDADSDSDSDSDSDSDSDSDADSDSDSDSDSDADSDSDSDSDSDADSDSDSDSDSDADSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDADSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 41943 - protein, 257 aa, Staphylococcus epidermidis
MKKIATATIATAGIATFAFAHHDAQAAEQNNDGYNPNDPYSYSYTYTIDAEGNYHYTWKGNWSPDRVNTSYNYNNYNNYNYYGYNNYSNYNNYSNYNNYNNYQSNNTQSQRTTQPTGGLGASYSTSSSNVHVTTTSAPSSNGVSLSNARSASGNLYTSGQCTYYVFDRVGGKIGSTWGNANNWANAAARSGYTVNNSPAKGAILQTSQGAYGHVAYVEGVNSNGSIRVSEMNYGHGAGVVTSRTISASQAASYNYIH

SEQ ID NO: 41944 - protein, 1245 aa, Staphylococcus epidermidis
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAEEGGNAEAPQSEPTKAEEGGNAEAAQSEPTKTEEGSNVKAAQSEPTKAEEGSNAEAPQSEPTKTEEGSNAKAAQSEPTKAEEGGNAEAAQSEPTKTEEGSNAEAPQSEPTKAEEGGNAEAPQSEPTKTEEGGNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPGTGEVVTPPVDDVTKYGPVDGDPITSTEEIPFDKKREFNPDLKPGEERVKQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPVDGDSITSTEEIPFDKKREFDPNLAPGTEKVVQKGEPGTKTITTPTTKNPLTGEKVGEGKSTEKVTKQPVDEIVEYGPTKAEPGKPAEPGKPAEPGKPAEPGTPAEPGKPAEPGTPAEPGKPAEPGKPAEPGKPAEPGKPAEPGTPAEPGTPAEPGKPAEPGTPAEPGKPAEPGTPAEPGKPAESGKPVEPGTPAQSGAPEQPNRSMHSTDNKNQLPDTGENRQANEGTLVGSLLAIVGSLFIFGRRKKGNEK

SEQ ID NO: 41945 - protein, 643 aa, Staphylococcus epidermidis
MKNNNETRRFSIRKYTVGVVSIITGITIFVSGQHAQAAEMTQSSSDFNEQSQQTEQVEHKEDTTHLSYELNQEGDTASQSKTNQENQSDGNVQKKSNQIQQDSTQTSPLNDQKQTSMEQQSKDNHVTPNSRQDTYPKGQNQDDKGKQQFKDNQHSQTGHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGIKYNVKKELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 41946 - protein, 395 aa, Staphylococcus epidermidis
  strain ATCC 12228
MKKKLSYMITIMLAFTLSLALGLFFNSAHADSLPQKNGANQKTTKVTVSNKDVPDAVRKLAEEQYLSRVALLDKASNHKATSYTLGEPFKIYKFNKESDGNYYYPVLNKKGDVVYVVTISPNPSNSKASKQQNNYSINVSPFLSKILNQYKNQKITILTNTKGYFALTEDGKVTLVLKTPRNNEKTYENATESTKPKDLNDFKQTASVTKPTLEYQSTRNEMYAEYVNQLKNFRIRETQGYNSWCAGYTMSALLNATYNTNRYNAESVMRYLHPNLRGHDFQFTGLTSNEMLRFGRSQGRNTQYLNRMTSYNEVDQLTTNNQGIAVLGKRVESSDGIHAGHAMAVAGNAKVNNGQKVILIWNPWDNGLMTQDAHSNIIPVSNGDHYEWYASIYGY

SEQ ID NO: 41947 - protein, 282 aa, Staphylococcus epidermidis; identical to SEQ ID NO: 41932
  strain ATCC 12228

SEQ ID NO: 41948 - protein, 507 aa, Staphylococcus epidermidis
  strain ATCC 12228
MKNFSKFALTSIAALTVASPLVNTEVDAKDKVSATQNIDAKVTQESQATNALKELPKSENIKKHYKDYKVTDTEKDNKGFTHYTLQPKVGNTYAPDKEVKVHTNKEGKVVLVNGDTDAKKVQPTNKVAISKESATDKAFEAIKIDRQKAKNLKSDVIKTNKVEIDGEKNKYVYNIEIITTSPKISHWNVKIDAETGQVVDKLNMIKEAATTGTGKGVLGDTKQININSVSGGYALQDLTQQGTLSAYNYDANTGQAYLMQDKDKNFVDDEQRAGVDANYYAKETYDYYKNTFGRESYDNQGSPIISIAHVNNFQGQDNRNNAAWIGDKMIYGDGDGRTFTALSGANDVVAHEITHGVTQQTANLVYRSQSGALNESFSDVFGYFIDDEDFLMGEDVYTPGVGGDALRSMSNPERFGQPSHMNDFVYTNSDNGGVHTNSGIPNKAAYNTIRSIGKQRSEQIYYRALTVYLTSNSDFQDAKASLQQAAFDLYGDGIAQQVGQAWDSVGV

SEQ ID NO: 41949 - protein, 688 aa, Staphylococcus epidermidis
  strain ATCC 12228
MKTRQNKYSIRKFSVGASSILIAALLFMGGGSAQAAEQQQDKGTVENSTTQSIGDGNEKLSEQQSTQNKNVNEKSNVNSITENESLHNETPKNEDWIQQQKDSQNDNKSESVVEQNKENEAFVQNHSEEKPQQEQVELEKHASENNQTLHSKAAQSNEDVKTKPSQLDNTAAKQEDSQKENLSKQDTQSSKTTDLLRATAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 41950 - protein, 257 aa, Staphylococcus epidermidis; identical to SEQ ID NO: 41943
  strain ATCC 12228

SEQ ID NO: 41951 - protein, 219 aa, Staphylococcus epidermidis; identical to SEQ ID NO: 39379
  strain ATCC 12228

SEQ ID NO: 41952 - protein, 728 aa, Staphylococcus epidermidis; identical to SEQ ID NO: 39721
  strain ATCC 12228

SEQ ID NO: 41953 - protein, 324 aa, Staphylococcus epidermidis
  strain ATCC 12228
MQKKYITAIIGTTALSALASTHAQAATTHTVKSGESVWSISHKYGISIAKLKSLNGLTSNLIFPNQVLKVSGSSSRATSTNSGTVYTVKAGDSLSSIAAKYGTTYQKIMQLNGLNNYLIFPGQKLKVSGKATSSSRAKASGSSGRTATYTVKYGDSLSAIASKYGTTYQKIMQLNGLTNFFIYPGQKLKVPGGSSSSSSSNNTRSNGGYYSPTFNHQNLYTWGQCTWHVFNRRAEIGKGISTYWWNANNWDNASAADGYTIDYRPTVGSIAQTDAGYYGHVAFVERVNSDGSILVSEMNWSAAPGNMTYRTIPAYQVRNYKFIH

SEQ ID NO: 41954 - protein, 1633 aa, Staphylococcus epidermidis
  strain ATCC 12228
MKKRRQGPINKRVDFLSNKVNKYSIRKFTVGTASILVGATLMFGAADNEAKAAEDNQLESASKEEQKGSRDNESSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSISTDSSVNDKQDYTRSAVASLGVDSNETEAITNAVRDNLDLKAASREQINEAIIAEALKKDFSNPDYGVDTPLALNTSQSKNSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFTPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISNVKVTLKNKNGDTIGTTTTDSNGKYEFTGLENGDYTIEFETPEGYTPTKQNSGSDEGKDSNGTKTTVTVKDADNKTIDSGFYKPIYNLGDYVWEDTNKDGIQDDSEKGISGVKVTLKDKNGNAIGTTTTDASGHYQFKGLENGSYTVEFETPSGYTPTKANSGQDITVDSNGITTTGIINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDSDSDSDSDSDSDSDSDSDSDSDSDSDADSDSDADSDSDSDSDSDSDSDSDSDSDSDSDSDSDSDADSDSDADSDSDADSDSDADSDSDSDSDSDADSDSDSDSDSDADSDSDSDSDSDADSDSDSDSDSDADSDSDSDSDSDADSDSDSDSDSDSDSDSDSDSDSDSDSDSDSDSDSDSDSDSDSDADSDSDSDSDSDADSDSDADSDSDSDSDSDSDSDSDADSDSDSDSDSDSDSDSDADSDSDSDSDSDAESDSDSDSDSDSDSDSDSDSDSDSDSDSDSDSDSDADSDSDSDSDSDSDSDSDSDSDSDSDSDSDADSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 41955 - protein, 235 aa, Staphylococcus epidermidis
  strain ATCC 12228
MKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 41956 - protein, 25 aa, Staphylococcus epidermidis
  strain ATCC 12228
MAADIISTIGDLVKWIIDTVNKFKK

SEQ ID NO: 41957 - protein, 3692 aa, Staphylococcus epidermidis
  strain ATCC 12228
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKIILEQKGNEKKSAIAQTPDATTEEKQEAVSAVSQAVTNGITHINQANSNDDVDQELSNAEQIITQTNVNVQKKPQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKSDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIVENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNNVVETTNQAIEDAPDTNQVNVEKNKGIGTIRDIQPLVVKKPTAKSKIESAVEKKKTEINQTQNATHDEVREGLNQLKQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQTLNEITIQLDAQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRAHKQIDEAETFVSVETIVRNFKVEADKLNSIVRKKAKALKEIELEADHVKQMINTNLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 41958 - protein, 291 aa, Staphylococcus epidermidis
  strain ATCC 12228
MKKIDSWLTKHGLKNRLTLVVIVIFIIFLILLFMFVNLSDEDTGQITITENAELRTGPNAAYPVIYKIEKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 41959 - protein, 827 aa, Staphylococcus epidermidis
  strain ATCC 12228
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKLATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 41960 - protein, 1335 aa, Staphylococcus epidermidis
  strain ATCC 12228
MAKKFNYKLPSMVALTLFGTAFTAHQANAAEQPQNQSNHKNVLDDQTALKQAEKAKSEVTQSTTNVSGTQTYQDPTQVQPKQDTQSTTYDASLDEMSTYNEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYNFDYDDEDDDSSTDHLEPISLNNVNATSKQTTSYKYKEPAQRVTTNTVKKETASNQATIDTKQFTPFSATAQPRTVYSVSSQKTSSLPKYTPKVNSSINNYIRKKNMKAPRIEEDYTSYFPKYGYRNGVGRPEGIVVHDTANDNSTIDGEIAFMKRNYTNAFVHAFVDGNRIIETAPTDYLSWGAGPYGNQRFINVEIVHTHDYDSFARSMNNYADYAATQLQYYNLKPDSAENDGRGTVWTHAAISNFLGGTDHADPHQYLRSHNYSYAELYDLIYEKYLIKTKQVAPWGTTSTKPSQPSKPSGGTNNKLTVSANRGVAQIKPTNNGLYTTVYDSKGHKTDQVQKTLSVTKTATLGNNKFYLVEDYNSGKKYGWVKQGDVVYNTAKAPVKVNQTYNVKAGSTLYTVPWGTPKQVASKVSGTGNQTFKATKQQQIDKATYLYGTVNGKSGWISKYYLTTASKPSNPTKPSTNNQLTVTNNSGVAQINAKNSGLYTTVYDTKGKTTNQIQRTLSVTKAATLGDKKFYLVGDYNTGTNYGWVKQDEVIYNTAKSPVKINQTYNVKPGVKLHTVPWGTYNQVAGTVSGKGDQTFKATKQQQIDKATYLYGTVNGKSGWISKYYLTAPSKVQALSTQSTPAPKQVKPSTQTVNQIAQVKANNSGIRASVYDKTAKSGTKYANRTFLINKQRTQGNNTYVLLQDGTSNTPLGWVNINDVTTQNIGKQTQSIGKYSVKPTNNGLYSIAWGTKNQQLLAPNTLANQAFNASKAVYVGKDLYLYGTVNNRTGWIAAKDLIQNSTDAQSTPYNYTFVINNSKSYFYMDPTKANRYSLKPYYEQTFTVIKQKNINGVKWYYGQLLDGKYVWIKSTDLVKEKIKYAYTGMTLNNAINIQSRLKYKPQVQNEPLKWSNANYSQIKNAMDTKRLANDSSLKYQFLRLDQPQYLSAQALNKLLKGKGVLENQGAAFSQAARKYGLNEIYLISHALVETGNGTSQLAKGGDVSKGKFTTKTGHKYHNVFGIGAFDNNALVDGIKYAKNAGWTSVSKAIIGGAKFIGNSYVKAGQNTLYKMRWNPANPGTHQYATDINWANVNAQVLKQFYDKIGEVGKYFEIPIYK

SEQ ID NO: 41961 - protein, 434 aa, Staphylococcus epidermidis; identical to SEQ ID NO: 39380
  strain ATCC 12228

SEQ ID NO: 41962 - protein, 646 aa, Staphylococcus epidermidis
  strain ATCC 12228
MSLPKKKIGIFAFFLLTVFTITLKTYFSYYVDFSLGVKGLVQNLILIMNPYSLIALVLSVFLFFKGKKAFWFIFIGGFLLTFLLYANVVYFRFFSDFLTFSTLNQAGNVESMGGAVSASFKWYDFVYFIDTIIYLAILIFKRKWLDNRAFSKKFVPVVMATSVALFFLNLAFAETDRPELLTRTFDHKYLVKYLGPYNFTVYDGVKTIENNQQKALASEDDLTKVLNYTKQKRTEPNPEYYGAAKKKNIIKIHLESFQTFLINKKVNGKEVTPFLNKLSSGNQDFTYFPNFFHQTGQGKTSDSEFTMDNSLYGLPQGSAYSLKGDNTYQSLPAILDQKQGYTSNVMHGDYKTFWNRDQVYKHFGIDNFYDATYYDMSDDNIVNLGLKDKPFFKASADYQSKMKKPFYSHLITLTNHYPFTLDEEDASIDKPNTGDSTVDGYIQTAHYLDQALEEYITDLKKKGLYDNSVIMIYGDHYGISENHNNAMEKLLGEKITPAKFTDLNRTGFWLKVPGKSGGVNKEYAGQMDVMPTLLHLVGIDSKNYLMFGSDMFSKQHNNVVPFRNGDFITEDYKYVNGKIYSNKDNELLTEKPKDFDKNKKQVEKDLEMSDSVLNGDLFRFYKNPDFKKVNPGKYEYKSGPKGNEKK

SEQ ID NO: 41963 - protein, 1056 aa, Staphylococcus epidermidis
  strain ATCC 12228
MINKKNNLLTKKKPIANKSNKYAIRKFTVGTASIVIGATLLFGLGHNEAKAEENSVQDVKDSNTDDELSDSNDQSSDEEKNDVINNNQSINTDDNNQIIKKEETNNYDGIEKRSEDRTESTTNVDENEATFLQKTPQDNTHLTEEEVKESSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDLGNSSDKSTKDKLPDTGANEDYGSKGTLLGTLFAGLGALLLGKRRKNRKNKN

SEQ ID NO: 41964 - protein, 1469 aa, Staphylococcus epidermidis
  strain ATCC 12228
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIQSNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYADGVMRADLDGATLTYTPKAVDGDPITSTKEIPFNKKREFDPNLAPGTEKVVQKGEPGIETTTTPTYVNPNTGEKVGEGTPTTKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGKPAEPGTPAEPGKPAEPGKPAEPGKPAEPGKPAEPGKPAEPGTPAEPGKPAEPGKPAEPGKPAEPGTPAEPGKPAEPGTPAEPGKPAEPGTPTQSGAPEQPNRSMHSTDNKNQLPDTGENRQANEGTLVGSLLAIVGSLFIFGRRKKGNEK

SEQ ID NO: 41965 - protein, 334 aa, Staphylococcus epidermidis
  strain ATCC 12228
MKRGVTILNWQRKCILTTLLVLSSLFLVFSTITYASERDFKDSLKITTHNVYFLPTAIYPNWGQSQRADLISKADYIQNQDVVILNELFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 41966 - protein, 681 aa, Staphylococcus epidermidis
  strain ATCC 12228
MTNNNRIKRFSIRKYAVGVVSIITGVTIFIGGQQAQAAETSVQHADAHPEDSQTTQQLKNDKVEETLKASKQGNADSQQVQTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQPLVKLQKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 41967 - protein, 205 aa, Staphylococcus epidermidis; identical to SEQ ID NO: 39382
  strain ATCC 12228

SEQ ID NO: 41968 - protein, 415 aa, Staphylococcus epidermidis
  strain ATCC 12228
MRSFMLKEVFKMTRCRSPTYITIKQIKNERNQNMKNKRTLLKVITSTSVALLLSNLVMNSVVRAESNTSVSSYQTTIQKYIVNKNKLVKEIKINKGDKVQFLIKSKVLNNEPITSIKFSDDFENVFDIDKNVEVFIPKDETTVHDSLNFKEDFNNVTKQGVLKVNEDNESFEWIANNPNEFSGKTLYLVVKGTTKKDADYKKYISDKLTSISDVAKEQINSQELTSNSVDVIIKPDSNKNLVFIQNALAHQHISLDLLNDKKNKKATNINQIQQTSSKSKDIQNSNNKVSNSNNKITLNITSDEYEKEKKNSKQVQDSNKLVDKEQKNTQNTKDLKKENTKDSSKNNLDSKDKENIKKDNNIKKATDKPTKEKLLPNTGMTDNITYVMVGLIISLGSSILLLKVASKHYKNRKKC

SEQ ID NO: 41969 - protein, 701 aa, Staphylococcus epidermidis
  strain ATCC 12228
MNNRDKLQKFSIRKYAIGTFSTVIATLVFMGINTNHASADELNQNQKLIKQLNQTDDDDSNTHSQEIENNKQNSSGQTESLRSSTSQNQANARLSDQFKDTNETSQQLPTNVSDDSINQSHSEANMNNEPLKVDNSTMQAHSKIVSDSDGNASENKHHKLTENVLAESRASKNDKEKENLQEKDKSQQVHPPLDKNALQAFFDASYHNYRMIDRDRADATEYQKVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYGDENFALLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSIDSVYDPLSYVKNVTGTVLGIYPSYLPYNQERWQGANAMNAYQIEELFSQENLQNAARSGRPIQFLVGFDVEDSHHNPETLLPVNLYVKPELKHTIELYHDNEKQDRKEFSVSK

SEQ ID NO: 41970 - protein, 643 aa, Staphylococcus epidermidis
  strain ATCC 12228
MKNNNETRRFSIRKYTVGVVSIITGITIFVSGQHAQAAEMTQSSSDFNEQSQQTEQVEHKEDTTHLSYELNQEGDTASQSKTNQENQSDENVQKKNNQTQQDSTQTSPLNDQEQTLKGQQSKDNHVTPNSRQDTYPKGQNQDDKGKQQFKDNQHSQTEHQPNTQNQNNDQDSSDKKQHPSDQTQAPSSKGTQPKQSQSIGDRDKTVKQPSSKVHKIGNTKTDKTVKTNQKKQTSLTSPRVVKSKQTKHINQLTAHAQYKNQYPVVFVHGFVGLVGEDSFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQKPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 41971 - protein, 172 aa, Staphylococcus epidermidis
  strain ATCC 12228
MKTKQLLSTTAIAGTLLLSGLHAPQAKAESNINGSNAVDIIQQVDKQHGNQPDLIRYGQPKDHGDYYEVTTNNKSGVGGAGITRLYKDGTVKHSTDSSGQDFKTFGHYEDTSSHNQNTPQAATQHTETSQHDTTDQTLPETGQSHTGITTMVGIVALMAGIGFIARRTSHKA

SEQ ID NO: 41972 - protein, 334 aa, Staphylococcus epidermidis; identical to SEQ ID NO: 41965
  strain ATCC 35984 / RP62A

SEQ ID NO: 41973 - protein, 2397 aa, Staphylococcus epidermidis
  strain ATCC 35984 / RP62A
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAEEGGNAEAPQSEPTKAEEGGNAEAAQSEPTKTEEGSNVKAAQSEPTKAEEGSNAEAPQSEPTKTEEGSNAKAAQSEPTKAEEGGNAEAAQSEPTKTEEGSNAEAPQSEPTKAEEGGNAEAPQSEPTKTEEGGNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKTGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPVDGDSITSTEEIPFDKKREFDPNLAPGTEKVVQKGEPGTKTITTPTTKNPLTGEKVGEGKSTEKVTKQPVDEIVEYGPTKAEPGKPAEPGKPAEPGKPAEPGTPAEPGKPAEPGTPAEPGKPAEPGKPAEPGKPAEPGKPAEPGTPAEPGTPAEPGKPAEPGTPAEPGKPAEPGTPAEPGKPAESGKPVEPGTPAQSGAPEQPNRSMHSTDNKNQLPDTGENRQANEGTLVGSLLAIVGSLFIFGRRKKGNEK

SEQ ID NO: 41974 - protein, 2402 aa, Staphylococcus epidermidis; identical to SEQ ID NO: 41940
  strain ATCC 35984 / RP62A

SEQ ID NO: 41975 - protein, 395 aa, Staphylococcus epidermidis; identical to SEQ ID NO: 41946
  strain ATCC 35984 / RP62A

SEQ ID NO: 41976 - protein, 643 aa, Staphylococcus epidermidis
  strain ATCC 35984 / RP62A
MKNNNETRRFSIRKYTVGVVSIITGITIFVSGQHAQAAEMTQSSSDSNEQSQQTEQVEHKEDTTHLSYELNQEGETASQSKTSQENQSDGNVQKKSNQIQQDSTQTSPLNDQKQTSMEQQSKDNHVTPNSRQDTYPKGQNQDDKGKQQFKDNQHSQTEHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGTKYNVKQELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 41977 - protein, 728 aa, Staphylococcus epidermidis
  strain ATCC 35984 / RP62A
MKNKKNSYSIRKLSVGASSIIVASMLFIGGGSVHAAESNHLENQEQSEVSVSHSIEMQHKNQETQQPENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKIKESREQEITNEQKQLQSKDIKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHTAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 41978 - protein, 688 aa, Staphylococcus epidermidis; identical to SEQ ID NO: 41929
  strain ATCC 35984 / RP62A

SEQ ID NO: 41979 - protein, 289 aa, Staphylococcus epidermidis; identical to SEQ ID NO: 41936
  strain ATCC 35984 / RP62A

SEQ ID NO: 41980 - protein, 235 aa, Staphylococcus epidermidis; identical to SEQ ID NO: 41955
  strain ATCC 35984 / RP62A

SEQ ID NO: 41981 - protein, 257 aa, Staphylococcus epidermidis; identical to SEQ ID NO: 41943
  strain ATCC 35984 / RP62A

SEQ ID NO: 41982 - protein, 219 aa, Staphylococcus epidermidis; identical to SEQ ID NO: 39379
  strain ATCC 35984 / RP62A

SEQ ID NO: 41983 - protein, 201 aa, Staphylococcus epidermidis
  strain ATCC 35984 / RP62A
MKKSKVLATTTLAGALLFTGVGATHNAHAADYVNDSNVRDYAKNAIGSKYTEAGSVSIGGHGGGVTDKDNGVKDNGDYYTVIFSGEKDNGVGAAKVYKDGRIEAQTPRDANNVLTIDAPNNTQSTDNNQAATNNNTTTATTDNDVSTQENNTQSTQTKEAQTTKALPETGEQSNSGLATIIASVLLAAGSLLAFRRTSNSK

SEQ ID NO: 41984 - protein, 25 aa, Staphylococcus epidermidis
  strain ATCC 35984 / RP62A
MAADIISTIGDLVKWIIDTVNKFKK

SEQ ID NO: 41985 - protein, 282 aa, Staphylococcus epidermidis
  strain ATCC 35984 / RP62A
MKKRFLSICTMTIAALATTTMVNTSYAKTDTESHNHSSLGTENKNVLDINSSSHNIKPSQNKSYPSVILPNNNRHQIFNTTQGHYDAVSFIYIPIHGGYMSGSGVVVGENEILTNKHVVNGAKGNPRNISVHPSAKNENDYPNGKFVGQEIIPYPGNSDLAILRVSPNEHNQHIGQVVKPATISSNTDTRINENITVTGYPGDKPLATMWESVGKVVYIGGEELRYDLSTVGGNSGSPVFNGKNQVIGIHYGGVDNKYNSSVYINDFVQQFLRNNIPDINIQ

SEQ ID NO: 41986 - protein, 3692 aa, Staphylococcus epidermidis
  strain ATCC 35984 / RP62A
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNNGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKIILEQKGNEKKSAIAQTPDATTEEKQEAVSAVSQAVTNGITHINQANSNDDVDQELSNAEQIITQTNVNVQKKPQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIVENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNAKNQLNQFIDNQKKIIENTPDATLEEKAEANRLLQNVLTSTSDEIANVDHNNEVDQALDKARPKIEAIVPQVSKKRDALNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEEKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAESIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 41987 - protein, 291 aa, Staphylococcus epidermidis
  strain ATCC 35984 / RP62A
MKKIDSWLTKHGLKNRLTLVVIVIFIIFLILLFMFVNLSDEDTGQITITENAELRTGPNAAYPVIYKIEKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQETLAQTLNSAIQKKALLTNRGSRQQNYQVLRQTDIPAVLLELGYISNPTDESMINDQLHRQVVEQAIVDGLKQYFSS

SEQ ID NO: 41988 - protein, 824 aa, Staphylococcus epidermidis
  strain ATCC 35984 / RP62A
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTHPANQENNAPQVGAGTPGAENTPQAGGESHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAATGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQSGATVKPSTTPNQDAEVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 41989 - protein, 1335 aa, Staphylococcus epidermidis; identical to SEQ ID NO: 41927
  strain ATCC 35984 / RP62A

SEQ ID NO: 41990 - protein, 434 aa, Staphylococcus epidermidis; identical to SEQ ID NO: 39380
  strain ATCC 35984 / RP62A

SEQ ID NO: 41991 - protein, 646 aa, Staphylococcus epidermidis
  strain ATCC 35984 / RP62A
MSLPKKKIGIFAFFLLTVFTITLKTYFSYYVDFSLGVKGLVQNLILLMNPYSLIALVLSVFLFFKGKKAFWFIFIGGFLLTFLLYANVVYFRFFSDFLTFSTLNQAGNVESMGGAVSASFKWYDFVYFIDTIIYLAILIFKRKWLDNRAFSKKFVPVVMATSVALFFLNLAFAETDRPELLTRTFDHKYLVKYLGPYNFTVYDGVKTIENNQQKALASEDDLTKVLNYTKQKRTEPNPEYYGAAKKKNIIKIHLESFQTFLINKKVNGKEVTPFLNKLSSGNQDFTYFPNFFHQTGQGKTSDSEFTMDNSLYGLPQGSAYSLKGDNTYQSLPAILDQKQGYTSNVMHGDYKTFWNRDQVYKHFGIDNFYDATYYDMSDDNIVNLGLKDKPFFKASADYQSKMKKPFYSHLITLTNHYPFTLDEEDASIDKPNTGDSTVDGYIQTAHYLDQALEEYITDLKKKGLYDNSVIMIYGDHYGISENHNNAMEKLLGEKITPAKFTDLNRTGFWLKVPGKSGGVNKEYAGQMDVMPTLLHLVGIDSKNYLMFGSDMFSKQHNNVVPFRNGDFITEDYKYVNGKIYSNKDNELLTEKPKDFDKNKKQVEKDLEMSDSVLNGDLFRFYKNPDFKKVNPGKYEYKSGPKGNEKK

SEQ ID NO: 41992 - protein, 892 aa, Staphylococcus epidermidis
  strain ATCC 35984 / RP62A
MFGLGHNEAKAEENTVQDVKDSNMDDELSDSNDQSSNEEKNDVINNSQSINTDDDNQIKKEETNSNDAIENRSKDITQSTTNVDENEATFLQKTPQDNTQLKEEVVKEPSSVESSNSSMDTAQQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 41993 - protein, 324 aa, Staphylococcus epidermidis; identical to SEQ ID NO: 41953
  strain ATCC 35984 / RP62A

SEQ ID NO: 41994 - protein, 205 aa, Staphylococcus epidermidis; identical to SEQ ID NO: 39382
  strain ATCC 35984 / RP62A

SEQ ID NO: 41995 - protein, 85 aa, Staphylococcus epidermidis
  strain ATCC 35984 / RP62A
MKKRRQEPINKRVDFLSNKVNKYSIRKFTVGTASILVGATLMFGAADNEAKAAEDNQLESASKEEQKGSRDFEVVLCHLFIEEFQ

SEQ ID NO: 41996 - protein, 681 aa, Staphylococcus epidermidis
  strain ATCC 35984 / RP62A
MTNNNRIKRFSIRKYAVGVVSIITGATIFIGGQQAQAAETSVQHADAHPEDSQTTQQLKNDKVEETLKASKQGNADSQQVQTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQPLVKLQKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 41997 - protein, 681 aa, Staphylococcus epidermidis 14.1.R1.SE
MTNNNRIKRFSIRKYAVGVVSIITGVTIFIGGQQAQAAETSVQHADAHPEDSQTTQQLKNDKVEETLKASKQGTADSQQVQTIDQSKTNQNNQHSVAESAQLKSDETANQAKEEEGSSVKQDVQPSKNVNQQDVATQSNEGENNDIKGEAQTSKASNQHTQSSNSHNQSTGTKDSDSEEIDQPLVKVQKPSNDSTYQTQSKEKQDSSKQLPQEKTTKRQIQTTENEQTTKVDSKKANDTQDVEKHTQEPKNDTSTSQKNHHQVATKEQSNRSTTSETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 41998 - protein, 2807 aa, Staphylococcus epidermidis 14.1.R1.SE
MNLFRKQKFSIRKFNIGIFSALIATVAFLAHPGQATASELEPSQNNDITAQSDGGLENTSQSNPISEETTNTLSEQTVPSSTETKQTQNDPHHNAQPIAINAEEAESAQTAPYTNIYENNDTSDNGLHVNQPVKHHIEAQSEDVTNHTNSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTTDNTVTGQQTPFSINVIMNKDDLSEQVNKDIIPSNYTLASYNKYNKLKERAQTVLDEETNNTPFNQRYSQTQIDDLLHELQTTLISRVSASREINDKAQEMTDGVYDSTELTTEEKDTLVDQIENHKNEISNNIDDELTDDGVERVKEAGLHTLESDTPHPVTKPNARQVVNNKAEQQKTLIRNNHEATTEEQNEAISQVEAHSSDAIAKIGEAETDTTVNEARDNGTRLIATDIPNPTKKAEAREAVTNSANSKIKDINNNTQATLDERNDAITLVNRSKDEAIQNINTAQGNDDVTEAQNNGTNTIQQVPLTPVKRQNAIATINAKADEQKRLIQANNNATTEEKADAERKVNEALLTATQNISNAPTNRDVDQAQTMGSGIISTISPATKIKEDARAAVEAKAIAQNQQINSNNMATTEEKQDALNQVEAHKQATIANINQAQSTQQVSEAKNNGINTMNQDQPNAVKKNNTKTLLEQKGNEKKSAIAQTPDATTEEKQEAVSVVSQAVTNGNNHINQANSNDDVDQALSNAEQIITHTDVNVQKKPQARQALIAKVNEKQSAINTDNEGTIEEKQKAIQSLNDAKNSADEQITQAASNQNVDNALNIGISNISKIQTNFTKKQQARDQVNQKFQEKEAELNSTPHATQDEKQDALTRLTQVKESTLNDINQAQTNQNVDTALTNGIQNIQVDVRKKQEARTTINDIVQQHKQTIQNNDDATTEEKEVANNLVNVSQQNVISKIDNATTNNQIDGIVSDGRQTINAITPDTSIKRNAKNDIDGKAADRKIKIQRINDATAEEIQEANRKIEEAKIEAKDNIQHSSTRDQVNEAKTNGINKIENITPATTVKSEARQAVQNKANEQINHIQNTPDATNDEKQEAINRVSAELARVQAQINAEHTTQGVKNIKDDAITSLSRINAQVVEKESARNAIEQKSTQQTQFINDNDNATDEEKEVANNLVIARKQNALDNINSLSSNSDIENAKVTGINEIAKVLPATSVKSKAKKDIDQKLAQQINQIQTHQTATIEEKEAAIQLANQKANEARTAIQNEHSNNGVAQAKSNGIHEIELVTPDAHKKSDAKQSIDDKYNEQSNTINTTPDATDEEKQKALDKLKIAKDAGYNKVDQAQTNQQVSDAKTEAIDTITNIQANVAKKPSARMELDSKFEDLKRQINATPNATEEEKQDAIQRLNVKREEVKNLINQDRRDNDVEQHKNTGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKTEVKSNITNSDTEREVNSAKTNGLEKINNIHPSTQTKTNAKQEINDKAQEQLIQINNTPDATEEEKQDATNRVNAGLAQAIQNINNAHSTQEVNESKTNSIATIKSVLPNVIKKPTAINDLTQEANNQKTLIGNDGNATDDEKEVAKQLVTQKLNEEIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIELSTQTKTQAKADIAQAIGQQRSTIDQNQNATTEEKQEALERLNQDTNGVNDRIQAALANQNVTDEKNNILETIRNVEPIVVVKPKANENIRKKAAEKTTLINQNQDATLEEKQIALGKLEEVKNEALNQVSQAHSNNDVKIAENNGIAKISEVHPETNIKRNAKQEIEQVAQSQIDTINTNNKSTNEEKSAAIDRVNVAKIDAINSITNATTTQLVNDAKNSGNTSITQILPSTAVKTNALAALATEAKNKNAIIDQTPNATAEEKEEANNKVDGLQEEADANILKAQTTEEVNNIKNQAVQNINAVQVEVIKKQNVKNQLNQFIDNQKKIIENTPDATLEEKAEANRLLQNVLTSASDEIANVDHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQPHPQTKATGRHRLNEKANQQQSTIATHPNSTIEERQEASTKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGIGTIRDIQPLVVKKPTAKSKIESAVEKRKLKLNKHKMQLMMK

SEQ ID NO: 41999 - protein, 354 aa, Staphylococcus epidermidis 14.1.R1.SE
MKDIKPNNSKLIQTYLSKKTIRYGTASALTLALYLFNSNVTVYADENTANQGTSPKTSQTAPTNNNENTDATAVTTDQNNNDEEEYDASYELPILYVTVWLDDQGNIIKDAVEDAKTPASERQPVKIPGYQHYRTSVSDGITKFIYRKISTAQSPIVENSQHNNTNKVVETTNQNKDEVNGKEQNQANTSVTNTQITKNEKDEDTKTLQKDKDEKESKDTKTPKKDKENKDTKNPKKDREEKKPVITSNGKDEKDEDRKTPKKDKEEKITKTSKKDREEKSPAIPKSDIDEKDTKITKKDKVDEITTTSKKDNNNDVQDKLPETGKSSDIQNPALIMLLAGLGLLGLFRNKIRE

SEQ ID NO: 42000 - protein, 291 aa, Staphylococcus epidermidis 14.1.R1.SE
MKKIDSWLTKHGLKNRLTLVVIAIFIIFLILLFMFVNLSDEDTGQITITDNAELRTGPNAAYPVIYKIDKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVEGLKQYFSS

SEQ ID NO: 42001 - protein, 727 aa, Staphylococcus epidermidis 14.1.R1.SE
MKNKKNSYSIRKLSVGASSIIVASMLFIGGGSVHAAESNHLENQEQSEVSASHSIELQHKDQEIQQPENKDNKNYHSETIDKNPTIHNNDYSYHETPSTDVKSNEGKQIDSQSNQPQTSMTKNDQQNPKKIGEHATNGINAKKEETRKNENAKSLVKPQQDDKTTSEQTKMKESREQEITNKQKQLQSKDVKNAQQENQNIEQEKSQEKINLQQSSIEKVQKSSRIDGKLDHQYNKDATQSNEDTASENVSEQHITAKDEGVTRNNRGDERLNQEKSTTSDKELKVDDIDKDLSTKESPENEKDDSRKGIKALTKNSQATTRNTATTEASKELKDQTNKVASQKEYKNHDPIILVHGFNGYASGTGPITGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42002 - protein, 688 aa, Staphylococcus epidermidis 14.1.R1.SE
MKTRQNKYSIRKFSVGASSILIAALLFMGGGSAQAAEQQQDKGTVENSTTQSIGDKNEKLSEQQSTQNKNVNEKSNVNSITENENLHNETPKNEDLIQQQKDSQNDNKSESVVEQNKKNEAFVQNHSEEKPQQEQVELEKHASENNQTLHSNAAQSNEDVKTKPSQLDNTTAQQEDSQKENLSKQDTQSSKNTDLLRTTGQNQSKDSQSTEEVNKEVNNDTQQVTAKKDDDKVETFNLNSKEEPLKVDKQANPTTDKDKSSKNDKGSQDGLANLESNAVATTNKHSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLVYDVGKMYGNKDSRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42003 - protein, 219 aa, Staphylococcus epidermidis 14.1.R1.SE
MKKTLVASSLAIGLGVVAGNAGHDAHASETTNVDKAELAQKALTNDQSLNESPVQEGAYNINFDYNGNSYHFESDGSTWSWSYESTNNATQPVQPSQSQVATQQQPVQVSAPQNEQTAQPQTKSTSASQTSSSKASSGSSVNVNSHLQQIAQRESGGDIHAINPSSGAAGKYQFLQSTWDSVAPSQYKGVSPAKAPESVQDKAAVKLYNTGGPGHWVTA

SEQ ID NO: 42004 - protein, 327 aa, Staphylococcus epidermidis 14.1.R1.SE
MNWQRKCILTTLLVLSSLFLVFSTITYASERDYKDSLKITTHNVYFLPTAIYPNWGQSQRADLISKADYIQNQDVVILNELFDKKASKRLLARLHSQYPYQTPIVGKGTEGWQNTTGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNKPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42005 - protein, 96 aa, Staphylococcus epidermidis 14.1.R1.SE
MIKKNNLLTKKKPIANKSNKYAIRKFTVGTASIVIGATLLFGLGHNEAKAEENTVQDVKDSNTDDELSDSNDQSSNEEKNDVINNSQSINTMMITK

SEQ ID NO: 42006 - protein, 801 aa, Staphylococcus epidermidis 14.1.R1.SE
MDTAQQPSHTTINSEASVQTSDNEENSRVSDFANSKIKESNTESDKEENTIEQPNKVREDSTTSQSSSYRNIDEKISNQDELLNLPINEYENKARPLSTTSAQSPIKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNANKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGAKVDHDSKGTLLGTLFAGLGALLVGNRRKNRKNKN

SEQ ID NO: 42007 - protein, 86 aa, Staphylococcus epidermidis 14.1.R1.SE
MSASTSESNITSNATSNSASNGESTNSSNVAQQSDHKDNSDETKELPETGNRNDTNNTNVLMGAVLSLLAGLGLVKKSRKNKEDKK

SEQ ID NO: 42008 - protein, 737 aa, Staphylococcus epidermidis 14.1.R1.SE
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAITHPADQENNAPQAGAGTPGAENTPQAGGENHNQDNAVTAAGTSGEQNGGKPATSTTGQDAAQPNGPQGTSVAQPGNDASSQGHDTPQADAGTHNTEGQPAVTTGEQAGGKPAATKPEGADTETAPAPNTADESHAQPSPQSGGTTATQAGQVKPSGDSTPTGKPNTADDQGTQIKPTSNQGTTATTGETGNQKPSGQTGNTENTPNDGTQVKPNNDPAVTGTPNANEEQTGQPNATVTPGQGNDEINGATKPGEVSPKPEENNPAVTEPGTTAPGNTNQGTQVKPNNDQTATGTQGATGDQNTQQGNTEQNNQNAEPLAPGTTDQAGATVKPGSAPNQDTEVKPNPDQNNNSPTGQDADQTGQGTQVKPNNDQTATGTQGATGDQNTQQGNTEQNNQNAEPLAPGTTDQAGATVKPGSAPNQDTEVKPNPDQNNKPTTGQDADQTGQGTQVKPNNNQTATGTQGATGDQNTQQGNTEQNNQNAEQGNTGQEGSNPNQSAQLGATVKPGSATNQDTEVKPNPDQNNKPTTGQDADQTGQSTHVKPNNGQTPTGTQGANGDQNTQQGNAGNKGNTDKDAKVNTNDDETKTDVKNGTELPETGLSNEYDYTTTVFGSIALISSLLLLRRQRKESK

SEQ ID NO: 42009 - protein, 235 aa, Staphylococcus epidermidis 14.1.R1.SE
MKKTVIASTLAVSLGIAGYGLSGHEAHASETTNVDKAHLVDLAQHNPEELNAKPVQAGAYDIHFVDNGYQYNFTSNGSEWSWSYTVAGSDADYTESSSNQEVSSNTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 42010 - protein, 1551 aa, Staphylococcus epidermidis 14.1.R1.SE
MKTDETKETSENKSAQDDDNIKEDSNTQEESTNTSLQSSEVPQTKKDTNETSETAIDEDASTKEQNNKDNDTAQDDDNIKEDSNTQEESTNTSSQSSEDSQTKKEQSDKSSNSIKEPDKQQEEVAKEEKATTEIADKNKELELKNNKTDKNEESELESNLSSSENKKDTVESFLNIQLSDSETKKIMENANIDYDKATDEEINTEILRASLIEMANNKKKTETLATPQRTMFRAMATPTALRAAVNQDEELKKSLGYTDNYTFASMLFDPGKLDSDDALNSNIIPFDLHSYMSGSNSGNRYKIDLKLDPIIAEHVTKISANPSGRNKPVEFVRIKDENGNLTDTWEVNFIRANDGLFGGAEILSQYTAKNGKIELDDTVGNIVSNAGNLSNNKLNYQVFVRDSKENKIVRTSESSGYFLTKADNDLVNLENNVSTENNDAFKASSGSATYNKDVGEFGGILIDQQIMKNGIFSYSKTKANQWSYNYQIDKDLLPYIEGVELHQYDYKGLNGFDKNYDAKNKVADLTIDEVGNGTITSDNLNKLIEFNNALPETVGVRVVLKLNQSVNNILTKDAKYDSDGNLIRETTKQKEDFTFAGYLTDSKGALINNTLGTSTLALQDYDKDGLLDRYERQVSLSDAESEDTDGDGKNDGDEVINYKTSPLVGKPQAADITTEDTVVSGSVPLKEGAATQTAKVINAEGTTVGTTTVNSDGTFSVSIPNSPEGTYTIAIDSPNYDNDEVNTFEIVDNSKLPAPSIDPVDDNDQQIVVNGTSGSTVTVTDSNNNVLGTVTIPVDDTSAAINVDTPLKAGTVLTSTASKDGKTSDVSDQITVTDATAPDAPTLNEVNTDATQVTGQAEPGSTVTVAFPGGGKASTTADDAGNFKVDIPSEVNLEGGETFTATATDKTGNESEPSTTTVVDTTAPDAPTINDVTSNDKVINGTAEPNSTVKLTFPDGTTAAGTTDSNGNYTVNIPENMSLKGGETISATSSDAEGNESESATTTVVDATAPDAPTINEVDTNATEVNGTAEPNSTVTVTFPDGTTATGTADDQGNYTIEIPSNVDLNGGEELQVTATDKDGNTSEPSSANVTDTTAPDAPTVNDVTSDATQVTGQAEPGSTVTVTFPDGTTATGTADDQGNYTIEIPSNVDLNGGEELQVTATDKDGNTSEPSSANVTDTTAPDAPTVNDVTSDATQVTGQAEPGSTVTVTFPDGTTATGTADDQGNYTIEIPSNVDLNGGEELQVTATDKDGNTSEPSSANVTDTTAPDAPTVNDVTSDATQVTGQAEPGSTVTVTFPDGTTATGTADDQGNYTIEIPSNVDLNGGEELQVTATDKGGNTSESTNTTVIDSDDNSDNGNNSGAGDNSDSDNNSGNGDNSGAGDNSDSDNNSGNGDSSNAGDNSDSDDNSDNGNNSGAGDNSDSDNNSGNGDNSSAGDNSDSDNNSGNGDNSSAGDNSDSDNNSDSGDNSNAGDNSDSNNNSNNEDNSSSNKDSINQDSNVNSNDSKHDKQNELPETGEKEVRNGTLFGTLFAGLGSLLLFTKRRRKENDKK

SEQ ID NO: 42011 - protein, 434 aa, Staphylococcus epidermidis 14.1.R1.SE; identical to SEQ ID NO: 39380

SEQ ID NO: 42012 - protein, 437 aa, Staphylococcus epidermidis 14.1.R1.SE
MNNRDKLQKFSIRKYAIGTFSTVIATLVFMGINPNHASADELNQNQKLIKQLNQTDDDDSNTHSQEIENNKQNSAGQTESLSSSTSHNQANARLSDQVKDPNETSQQLPTNVSNDSINQSHNETNMNNEPLQVDNSTMQAHSKKVSDSNGNTSGNEHHKLTENVLAESRASKNDKEKENLQEKDKPQQVQPPLDKNALQAFFDASYYNYRMIDRDRADTTEYQKVKSAFDYVNDLLGNNQNIPSEQLVSAYQQLEKALELARTLPQRSTTEKRGRRSTRSVVEERSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYA

SEQ ID NO: 42013 - protein, 206 aa, Staphylococcus epidermidis 14.1.R1.SE
MKKSRVLATTTLAGALLFTGLGNVDAAQTVNDSNIREYAQNTLGSHYTKSGAVSIGGGWSDIEPEDHGIKDRGNYYDVVFYGEKDNGIGVAKVYKDGRVEARTPRDPDKVLSINAPENAQSTNDNNQATDNNQATDNNQATDNNQATDNNQATDNNQATDNAKAENNVQALPETGEQSNSGLVTVIASVLLAAGSLLTFRRVSKSK

SEQ ID NO: 42014 - protein, 707 aa, Staphylococcus epidermidis AU12-03
MTLKDKNGNAIGTTTTDVSGHYQFKGLENGSYTVEFETPSGYTPTKANSGQDITVDSNGITTTGIINGADNLTIDSGFYKTPKYSVGDYVWKDTNKDSIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDSDSDSDSDSDSDSDSDSDSDSDSDSDADSDSDSDSDSDADSDSDSDSDSDSDSDSDADSDSDSDSDSDADSDSDSDSDSDADSDSDSDSDSDSDSDSDSDSDSDSDSDSDSDSDSDSDADSDSDSDSDSDADSDSDSDSDSDADSDSDADSDSDSDSDSDADSDSDADSDSDSDSDSDADSDSDSDSDSDSDSDSDSDSDSDSDSDSDADSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDADSDSDSDKNAKDKLPDTGANEDHDSKGTLLGTLFAGLGALLLGRRRKKDNKEK

SEQ ID NO: 42015 - protein, 2135 aa, Staphylococcus epidermidis AU12-03
MKNKQGFLPNLLNKYGIRKLSAGTASLLIGATLVFGINGQVKAAETDNIVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLSNDANHQTTDEVNHSDSDNMTNSTPNDTENELDTTQLTSHDESPSPQSDNFTGFTNLMATPLNLRNDNPRINLLAATEDTKPKTYKKPNNSEYSYLLNDLGYDATTVKENSDLRHAGISQSQDNTGSVIKLNLTKWLSLQSDFVNGGKVNLSFAQSDFYTQIESITLNDVKMDTTNNGQNWSAPINGSTVRSGLIGSVTNHDIVITLKNSQTLSSLGYSNNKPVYLTHTWTTNDGAIAEESIQVASITPTLDSKAPNTIQKSDFTAGRMTNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSGQLSNARTSLDRNVFFGTLGQSRSYTISYKLKDGYTLESVASKVSARETFDSWMEVDYLDSYDSGAPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNVTETIFTIDVEDTTKPTVESIAGQTQEVNTEIEPIKIEAKDNSGQTVTNKVDGLPDGVTFDEATNTISGTPSEVGSYTVTVTTMDESGNATETTFTIDVEDTTKPTVESVADQTQEVNTEITPITIESEDNSDQAVTNKVDGLPDGVTFDEATNTISGTPSEVGSYTVTVTTTDESGNATETTFTIDVEDTTKPTVKSVSDQTQEVNTEITPIKIEATDNSGQTVTNKVDGLPDGITFDEATNTISGTPSEVGSYDITVTTTDENGNSETTTFTIDVEDTTKPTVEDITDQTQEINTEMTPIKIEATDNSGQAVTNKVEGLPDGVTFDEATNTISGTPSEVGSYDITVTTTDENGNSETTTFTIDVEDTTKPTVESVADQTQEINTKIEPIKIEARDNSGQAVTNKVDGLPDGVTFDEATNTISGTPSEVGSYTVTVTTTDESGNATETTFTIDVEDTTKPTVEDIANQTQEVNTEIEPIKIEATDNSGQAVTNKVDGLPDGVTFDEATNTISGTPSEVGSYDITVTTTDKNGNSETTTFTIDVEDTTKPTVESVADQTQEVNTEITPITIESEDNSGQTVTNKVDGLPDGVTFDEATNTISGTPSKVGSYDITVTTTDENGNSETTTFTIDVEDTTKPTVESVADQTQEVNTEINPIKIEATDNSGQAVTNKVEGLPAGITFDEATNTISGTPSEVGSYTVTVTTTDENGNATETTFTIDVEDTTKPTVEDITDQTQEINTEINPIKIETTDNSGQTVTNKVEGLPDGVTFDEATNTISGTPSEVGSYTVTVTTTDENGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPTINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42016 - protein, 441 aa, Staphylococcus epidermidis AU12-03
PVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGTPAEPGKPAEPGKPAEPGKPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42017 - protein, 434 aa, Staphylococcus epidermidis AU12-03; identical to SEQ ID NO: 39380

SEQ ID NO: 42018 - protein, 59 aa, Staphylococcus epidermidis AU12-03
PGNPDQSKNVNHSTINKDHLPDTGDNSKSNQGILAGSLLSILGSLFIFGRRKNKDNSEK

SEQ ID NO: 42019 - protein, 25 aa, Staphylococcus epidermidis AU12-03
MAADIISTIGDLVKWIIDTVNKFKK

SEQ ID NO: 42020 - protein, 327 aa, Staphylococcus epidermidis AU12-03
MNWQRKCILTTLLVLSSLFLVFSTITYASERDFKDSLKITTHNVYFLPTAIYPNWGQSQRADLISKADYIQNQDVVILNELFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42021 - protein, 94 aa, Staphylococcus epidermidis AU12-03
MGKRRQGPINKKVDFLPNKLNKYSIRKFTVGTASILLGSTLIFGSSSHEAKAAEEKQVDPITQANQNDSSERSLENTNQPTVNNEAPQMSSTLQ

SEQ ID NO: 42022 - protein, 219 aa, Staphylococcus epidermidis AU12-03; identical to SEQ ID NO: 39379

SEQ ID NO: 42023 - protein, 343 aa, Staphylococcus epidermidis AU12-03; identical to SEQ ID NO: 39377

SEQ ID NO: 42024 - protein, 688 aa, Staphylococcus epidermidis AU12-03; identical to SEQ ID NO: 41949

SEQ ID NO: 42025 - protein, 880 aa, Staphylococcus epidermidis AU12-03
MFGLGHNEAKAEENTVQDVKDSNMDDELSDSNDQSSNEEKNDVINNSQSINTDDDNQIKKEETNSNDAIENRSKDITQSTTNVDENEATFLQKTPQDNTQLKEEVVKEPSSVESSNSSMDTAQQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 42026 - protein, 291 aa, Staphylococcus epidermidis AU12-03; identical to SEQ ID NO: 39372

SEQ ID NO: 42027 - protein, 681 aa, Staphylococcus epidermidis AU12-03
MTNNNRIKRFSIRKYAVGVVSIITGVTIFIGGQQAQAAETSVQHADAHPEDSQTTQQLKNDKVEETLKASKQGTAYSQQVQTINQSKTNQNNQHSVAESEQLKSDETANQPKKEEGSSVKQDVQPSKNVNQQDAATQSNERKNIDIKGEGQTSKTSNQHIQSSNSHNQSTETKDSDSEEIDQPLVKLQKPSNDSTYQTQSKAKQDSSKQLPQEKTTKRQIQTTENEQTTKVDSKKANDTQNVEQHTQEPKNDTSTSQKNHHQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42028 - protein, 728 aa, Staphylococcus epidermidis AU12-03; identical to SEQ ID NO: 39721

SEQ ID NO: 42029 - protein, 235 aa, Staphylococcus epidermidis AU12-03; identical to SEQ ID NO: 41955

SEQ ID NO: 42030 - protein, 815 aa, Staphylococcus epidermidis AU12-03
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQADGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNLDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 42031 - protein, 3692 aa, Staphylococcus epidermidis AU12-03
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEESESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEAKAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42032 - protein, 343 aa, Staphylococcus epidermidis BCM-HMP0060; identical to SEQ ID NO: 39377

SEQ ID NO: 42033 - protein, 892 aa, Staphylococcus epidermidis BCM-HMP0060; identical to SEQ ID NO: 41992

SEQ ID NO: 42034 - protein, 434 aa, Staphylococcus epidermidis BCM-HMP0060; identical to SEQ ID NO: 39380

SEQ ID NO: 42035 - protein, 803 aa, Staphylococcus epidermidis BCM-HMP0060
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQFNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNLDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 42036 - protein, 291 aa, Staphylococcus epidermidis BCM-HMP0060; identical to SEQ ID NO: 39372

SEQ ID NO: 42037 - protein, 3692 aa, Staphylococcus epidermidis BCM-HMP0060
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEESESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAEAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42038 - protein, 205 aa, Staphylococcus epidermidis BCM-HMP0060
MEEKFNNSQEERQFQQFQEYQKRQEEEKKKKRKKGWLFGCGGCLVLLILIIVGVTACTGTFVNEVDKEINEEGKLDKDKDTKIKSIGETTEIDGVSFTLDNASYTEERNEFADVQADKVIKVDMTVKNNSKEEIPVGGDIKVYVDGKQAKSYPIYNQLIDSLSPNREISGSEGFAINGNPKKIELEFQPLTSFSNKRYIYNIKPE

SEQ ID NO: 42039 - protein, 133 aa, Staphylococcus epidermidis BCM-HMP0060
DSDSDSDADSDSDADSDSDSDSDSDADSDSDSDSDSDSDSDSDSDSDSDSDSDSDSDSDSDSDSDSDADSDSDSDSDSDADSDSDSDKNAKDKLPDTGANEDHDSKGTLLGTLFAGLGALLLGRRRKKDNKEK

SEQ ID NO: 42040 - protein, 771 aa, Staphylococcus epidermidis BCM-HMP0060
MKKRRQGPINKRVDFLSNKVNKYSIRKFTVGTASILVGATLMFGAADNEAKAAEDNQLESASKEEQKGSRDNENSKLNQVDLDNGSHSSEKTTNVNNATEVKKVEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSVSTDSSVNDKQDYTRSAVASLGVDSNETEAITNAVRDNLDLKAASREQINEAIIAEALKKDFSNPDYGVDTPLALNTSQSKNSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVSYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKY

SEQ ID NO: 42041 - protein, 681 aa, Staphylococcus epidermidis BCM-HMP0060
MTNNNRIKRFSIRKYAVGVVSIITGVTIFIGGQQAQAAETSVQHADAHPEDSQTTQQLKNDKVEETLKASKQVNADSQQVQTIDQSKTNQNNQHSVAESAQLKSDETANQPKKEESSSVKQDVQPSKNVNQQDVATQSNERENNDIKGEGQTSKTSNQHIQTSNSHNQSTGTKDSDSEEIDQPLVKLQKPSNDSTYQTQSKTKQDSSKQLPQEKTTKRQIQTTENEQTTKVDSKKANDTQNVEKHTQEPKNDTSTSQKNHHQVATKEQSNRSTTRKTQKQSSNANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDVNKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42042 - protein, 334 aa, Staphylococcus epidermidis BCM-HMP0060
MKRGVTILNWQRKCILTTLLVLSSLFLVFSTITYASERDFKDSLKITTHNVYFLPTAIYPNWGQSQRADLISKADYIQNQDVVILNELFDKKASKRLSTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42043 - protein, 680 aa, Staphylococcus epidermidis BCM-HMP0060
MKKKLDFLPNKLNKYSIRRFTVGTASILVGSTLLFGIGNEAHAAEEHQKSNTTENVADSNASEAPTKEEAPSNEATSEAPTKEEVPSNEATSEAPTKEEAPSNEATSEAPTKEEAPSNEATSEASTKEEAPAAEETDKATEEAPKTEETDKATKEEAPAVEETSKAATEEAPKAEETDKATEEAPKTEETSKAATEKAPKAEETNKVETEEAPAAEETNKAATEETPAVEDTNAKSNSNAQPSETERTQVVDTVAKDLYKKSEVTEAEKAEIEKVLPKDISNLSNEEIKKIALSEVLKETANKENAQPRATFRSVSSNARTTNVNYSATALRAAAQDTVTKKGTGNFTAHGDIIHKTYKEEFPNEGKLTAFNTNFNPDTGTKGALEYNDKIDFNKDFTITVPVANNNQGNTTGADGWGFMFTQGNGQDFLNQGGILRDKGMANASGFKIDTAYNNVNGKVDKLDADKTNNLSQIGAAKVGYGTFVKNGADGVTNQVGQNALNTKDKPVNKIIYADNTTNHLDGQFHGQRLNDVVLNYDAATSTITATYAGKTWKATTDDLGIDKSQKYNFLITSSHMQNRYSNGIMRTNLEGVTITTPQADLIDDVEVTKQPIPHKTIREFDPTLEPGSPDVIVQKGEDGEKTTTTPTKVDPDTGDVVERGEPTTEVTKNPVDEIVHFAP

SEQ ID NO: 42044 - protein, 94 aa, Staphylococcus epidermidis BCM-HMP0060; identical to SEQ ID NO: 42021

SEQ ID NO: 42045 - protein, 71 aa, Staphylococcus epidermidis BCM-HMP0060
MEPGKPVEPGTPAQSGAPEQPNRSMHSTDNKNQLPDTGENRQANEGTLVGSLLAIVGSLFIFGRRKKGNEK

SEQ ID NO: 42046 - protein, 728 aa, Staphylococcus epidermidis BCM-HMP0060; identical to SEQ ID NO: 39721

SEQ ID NO: 42047 - protein, 688 aa, Staphylococcus epidermidis BCM-HMP0060; identical to SEQ ID NO: 41949

SEQ ID NO: 42048 - protein, 235 aa, Staphylococcus epidermidis BCM-HMP0060; identical to SEQ ID NO: 41955

SEQ ID NO: 42049 - protein, 219 aa, Staphylococcus epidermidis BCM-HMP0060; identical to SEQ ID NO: 39379

SEQ ID NO: 42050 - protein, 992 aa, Staphylococcus epidermidis BVS058A4
MINKKNNLLTKKKPIANKSNKYAIRKFTVGTASIVIGATLLFGLGHNEAKAEENSVQDVKDSNTDDELSDSNDQSSDEEKNDVINNNQSINTDDNNQINKKEETNSNDGIEKRSEDRTESTTNVDENEATFLQKTPQDNTHLTEEEVKEPSSVESSNSSINTAQQPSHTTINREASVQTSDNVEDSHVSDFANSKIKESNTESGKEENTIEQPNKVREDSTTSHPTGYKNIDEKISNQDELLNLPINEYENKARPLSTTSAQPSIKRVTVNQLAAEQGSNVNHLIKVTDQSITEGYDDSEGIIKAHDAENLIYDVTFEVDDKVKSGDTMTVNIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQKPNENQTANLQSMFTNIDTKNHTVEQTIYINPLRYSAKETNVNISGNGDEGSTIIDDSTIIKVYKVGDNQNLPDSNRIYDYSKYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSGSDSDSDSDSDSDSDSDSDSDSDSDSDSDSDSDSDSDSDSDSDSDSDSDSDSDSDSGNSSDKSTKDKLPDTGANEDYDSKGTLLGTLFAGLGALLLGKRRKNRKNKN

SEQ ID NO: 42051 - protein, 219 aa, Staphylococcus epidermidis BVS058A4
MKKTLVASSLAIGLGVVAGNAGHDAHASETTNVDKAELAQKALTNDQSLNESPVQEGAYNINFDYNGNSYHFESDGSTWSWSYESTNNATQPVQPSQSQVATQQQPVQVSAPQNEQTAQPQTKSTSASQTSSSKASSGSSVNVNSHLQQIAQRESGGDIHAINPSSGAAGKYQFLQSTWDSVAPSQYKGVSPAKAPESVQDQAAVKLYNTGGPGHWVTA

SEQ ID NO: 42052 - protein, 328 aa, Staphylococcus epidermidis BVS058A4
MKDNKPNNSKLIQTYLSKKTLRYGTASALTLALYLFNSNVTVYADENTANQNQGTSPKTSQTAPTNNNENTDATAVTTDQNNNDEEEYDASYEIPILYVTVWLDDQGNIIKDAVEDAKTPASERQPVKIPGYQHYRTSVSDGITKFIYRKISTAQSPIVENNQQDNNTNKVVETTNQNKDEVNGKEQNQADTSVTNTQITKNEKDEDTKLLQKDEDTKLLQKDKDEKESKDAKTSKKDKKEKITKTPKKDREKKSSVIPKTGKDEKDTKITKKDNEDEITTTSKKDNNNDIQDKLPETGKSNDIQNPALIMLLAGLGLLGLFRNKIRE

SEQ ID NO: 42053 - protein, 172 aa, Staphylococcus epidermidis BVS058A4
MKTKQLLSTTAIGGTLLLSGLHAPQAKAESNINGSNAVDIIQQVDKQHGNQPDLIRYGQPKDHGDYYEVTTNNKSGVGGAGITRLYKDGTVKHSTDSSGQDFKTFGHYEDTSSHNQNTPQAATQHTETSQHDTTDQTLPETGQSHTGITTMVGIVALMAGIGFIARRASHQA

SEQ ID NO: 42054 - protein, 720 aa, Staphylococcus epidermidis BVS058A4
MVLQQHKGDNPTYSLGDYVWLDKNKNGVQDDDEKGLAGVYVTLKDSNNRELQRVTTDQSGHYQFDNLQSGTYTVEFAIPDNYTPSLANNSTNDAIDSDGERDGTRKVVVAKGTINNADNMTVDTGFYLTPKYNVGDYVWEDTNKDGIQDDNEKGISGVKVTLKNKNGDTIVTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSGQDITVDSNGITTTGVINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDSDSDSDSDSDSDSDSDSDSDSDSDADSDSDSDSDSDADSDSDSDSDSDADSDSDADSDSDSDSDSDSDSDSDSDSDSDSDSDSDADSDSDSDSDSDADSDSDSDSDSDSDSDSDSDSDSDSDSDSDSDSDSDADSDSDSDSDSDADSDSDSDSDSDADSDSDSDSDSDADSDSDSDSDSDSDSDSDSDSDSDSDSDSDSDSDSDSDKNAKDKLPDTGANEDHGSKGTLLGTLFAGLGALLLGRRRKKDNKEK

SEQ ID NO: 42055 - protein, 676 aa, Staphylococcus epidermidis BVS058A4
MKKRRQGPINKRVDFLSNKVNKYSIRKFTVGTASILVGATLMFGAADNEAKAAEDNQLESASKEEQKGSRDNESSKLNQVDLDNGSHSSEETTNVNNATEVKKVEAPTTSDVSNTKANEAVVTNESTKPKTIEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSISTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQSYPMEVTIADEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFASSMANGKKYIVTQAVRPTGTGNVYTEYWLTRDGTTNTNDFYRGTKSTTVSYLNGSSTAQRG

SEQ ID NO: 42056 - protein, 235 aa, Staphylococcus epidermidis BVS058A4; identical to SEQ ID NO: 41955

SEQ ID NO: 42057 - protein, 688 aa, Staphylococcus epidermidis BVS058A4
MKTRQNKYSIRKFSVGASSILIAALLFMGGGSAQAAEQQQDKGTVENSTTQSIGDENEKLSEQQSTQNKNVNEKSNVNSITENESLHNETPKNEDLIQQQKDSQNDNKSESVVEQNKENEAFVQNHSEEKPQQEQVELEKHASENNQTLHSKAAQSNEDVKTKPSQLDNTTAQQEDSQKENLSKQDTQSSKTTDLLRATGQNQSKDSQSTEEVNKEVNNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLTYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42058 - protein, 231 aa, Staphylococcus epidermidis BVS058A4
KPTINKVTENSTEVSGRGEPGTVVEVTFPDGNKVEGKVDSDSNYHIQIPSDEKLKVGQQLIVKVVDEEGNVSEPSIAMVQEENKNSEKPSTVTDTVTKNNSKSLNHKASEQQSYHNKSEKIMSVNKPTKIVEKDMSTYDYSRYSKDISNKNNKSETFEQQKVSDINNNQHSRNKVNEPVKKSRKNEINKDLPQTGEENFNKSTLFGTLVASLGALLLFFKRRKKDEEDGKE

SEQ ID NO: 42059 - protein, 889 aa, Staphylococcus epidermidis BVS058A4
MKNKQGFLPNLLNKYGIRKLSAGTASLLIGATLVFGINGQVKAAETDNTVSQSGDNKTNDSESSDKELVKSEDDKTSNTSTDTNLESEFEQNNNPSSIEESTNRNDEDTLNQKTSTETEKDTHVKSADTQTTNETTNKNDDNATTNHTESTSDESTYQSDDVKTTQHDNSNTNQDTQSTLNPTSKESSNKDEATSPTPKESTSIEKTNLSNDANHQTTDEVNHSDSDNMTNSTPNDTEKELDTTQLTSHDESPLPQSDNFTGFTNLMATPLNLRNDNPRINLLAATEDTKPKTYKKPNNSEYSYLLNDLGYDATTIKENSDLRHAGISQSQDNTGSVIKLNLTKWLSLQSDFVNGGKVNLSFAQSDFYTQIESITLSGVKMDTTNNGQNWSAPINGSTVNSGLIGSVTNHDIVITLKNSQTLSSLGYSNNKPVYLTHTWTTNDGSIAEESIQVASITPTLDSKAPNTTQTSGFTAGRVVNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSSQLNNARTSLDKNVFFGTLGQSRSYTISYKLKDGYTLESVASKVSARETFDSWMEVDYLDSYDSGAPNKRLFGSYASSYIDMIDRIPPVAPKANDITTEDTSIKGTAEADTNINLTFNDGRTLNGKVDSNGNFSITIPSDYVLTGKETIKITSIDKGDNVSPAITISVIDKTPPAVKAISNKTQEVNTAFNPFIIEATDNSGDKVIHDVRGLPAGVTFNNSSNMISGTPTNVGAYTVTVISKDVKGNETETSFKINVVDTIKPTVEDITDQTQEVNTEIEPITIESEDNSGQAVTNKVEGLPDGVTFDEATNTI

SEQ ID NO: 42060 - protein, 327 aa, Staphylococcus epidermidis BVS058A4
MNWQRKCILTTLLVLSSLFLVFSTITYASERDSKDSLKITTHNVYFLPTAIYPNWGQSQRADLISKADYIQNQDVVILNELFDKKASNRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42061 - protein, 681 aa, Staphylococcus epidermidis BVS058A4
MTNNNRIKRFSIRKYAVGVVSIITSVTIFIGGQQAQAAETSVQHADAHPEDSQTTQQLKNDKVEETLKASKQGTADSQQVQTIDQSKTNQNNPHSVAESAQLKSDETANQPKKEEGSSVKQDVQPSRNVNQQDVATQSNERENNDIKGEGQTSKASNQHIQSSNSHNQSTEIKDSDSEEIDQPLVKVQKPSNDSTYQTQSKEKQDSSKQLPQEKTTKRQIQTTENEQTTKVDSKKANDTQDVEQHTQEPKNYTSTSQKNHHQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42062 - protein, 728 aa, Staphylococcus epidermidis BVS058A4
MKNKKNSYSIRKLSVGASSIIVASMLFIGGGSVHAAESNHLENQEQSEVSASHSIEMQHKNQETQQPENKDNKTNHSETIDKTPTIHNNGYSYHETPSTEVKSNEDKQIDSQSNQPQTSMPNNDQQNPKKVAEHVTKSINAKKEETRKNENAKSLVQPQQDDKTTSEQTKMKESREQEITNEQKQLQSKDIKNAQQENQNIDKEKSQEKIKVQQSNIEKAQKSSRIDGKLDNQYNKDATQSNEGTASENVSEQHITAKDTGVTRNNRGDERLHQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQRDDETLVQYIQRVKQSKLWTTKDNGFYDLTTEGTDILNQKTSLNPNIVYKTYQGESTRPGANGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42063 - protein, 291 aa, Staphylococcus epidermidis BVS058A4; identical to SEQ ID NO: 41958

SEQ ID NO: 42064 - protein, 1715 aa, Staphylococcus epidermidis BVS058A4
MNLFRKQKFSIRKFNIGIFSALIATVAFLAHPGQATASELEPSQNNDTTAQSDGGLENTSQSNPISEETTNTLSGQTVPSSTENKQTQNDPNHNAQPIAINTEEAESAQTVSYTNINENNDTSGDGLHVNQPAKHHIEAQSEDVTNHTNPNHSNSSIPENKATTESSSKPKKRGKRSLDSNSGNDTTSTTQNTDPNLSNTGPNGINTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAETNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKITLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINVKADEQKRLIQANNNATTEEKADAERKVNEAVITATQNITNATTNRDVDQAQTTGSGIISAISPATKIKEDARAAVEAKAIAQNQQINSNNMATTEEKQDALNQVEAHKQVAIANINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQTINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVAEKESARNAIEQKATQQTQFINNNDNATDEEKEVANNLVIATKQKSLNNINSLSSNSDVENSKVAGINEIANVLPATAVKSKAKKDIDQKLAQQINQIQTHQTVTTEEKEAAIQLANQKSNEARTAIQNEHSNNGVAQAKSNGIHEIELVTPDAHKKSDAKQSIDDKYNEQSNTINTTPDATDEEKQKALDKLKIAKDAGYNKVDQAQTNQQVSDAKTEAIDTITNIQANVAKKTIRSSGIRFKV

SEQ ID NO: 42065 - protein, 2405 aa, Staphylococcus epidermidis BVS058A4
MSYSLSKLSTLKTYNFQITSNNKEKTSRIGVAIALNNRDKLQKFSIRKYAIGTFSTVIATLVFMGINTNHASADELNQNQKLIKQLNQTDDDDSNTHSQEIENNKQNSSGQTESLRSSTSQNQPNAQLSDQIKDTNETSQQLPTNVSDDSINQSHSEANMNNKPLKIDNSTMQAHSKILSDSDGNASENEHHKLTENVLAESRASKNDKEKENLQEKDKSQQVQPPLDKNALQAFFDASYHNYRMIDRDRSDATEYQKVKSAFDYVNDLLGNNQNVPSEKLVSAYQQLEKALELARTLPQRSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGSVTFTIINRDGSSTSTGGVGFGSGAPLPQFWRSAGAINSSVANDFKHGSATNYAFYDGVNNFSDFARGGELYFDREGATQTNKYYGDENFAMLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSNDSVYDPLSYVKNVNGTVLGIYPSYLPYNQERWQGANAMNAYQIEELFSQENLQNAARSGRPIQFLVGFDVEDSHHNPETLLPVNLYVKPELKHTIELYHDNEKQDRKEFSVSKRAGHGVFQVMSGMLHNTVRSGILPYQQEIRIKLTSNEPIKDSEWSITGFPNTLTLQNAVGRTNNATEKNLALVGHIDPGNYFITVKFGDKVEQFEIRSKPTPPRIITTANELRGNPNHKPEIRVTDIPNDTTAKIKLVMGGTDGDHDPEINPYTVPENYTVVAEAYHDNDPSKNGVLTFRSSDYLKDLPLSGELKAIVYYNQYVQSNFSNSVPFSSDTTPPTINEPAGLVHKYYRGDHVEITLPVTDNAGGSGLRDVNVNLPQGWTKTFTINPNNNTEGTLKLIGNIPSNEAYNTTYHFNITATDNSGNTTNPAKTFILNVGKLADDLNPVGLSRDQLQLVTDPSSLSNSEREEVKRKVSEANANIRSYLLQNNPILAGVNGDVTFYYRDGSVDVIDAENVITYEPERKSIFSENGNTNKKEAVITIARGQNYSIGPNLRKYFSLSNGSDLPNRDFTSISAIGSLPSSSEISRLNVGNYNYRVNAKNAYHKTQQELNLKLKIVEVNAPTGNNRVYRVSTYNLTNDEINKIKQAFKAANSGLNLNDNDITVSNNFDHRNVSSVTVTIRKGDLIKEFSSNLNNMNFLRWVNIRDDYTISWTSSKIQGRNTDGGLEWSPDHKSLIYKYDATLGRQINTNDVLTLLQATAKNSNLRSNINSNEKQLAERGANGYSKSIIRDDGEKSYLLNSNPIQVLDLVEPDNGYGGRQVSHSNVIYNEKNSSIVNGQVPEANGASAFNIDKVVKANAANNGIMGVIYKAQLYLAPYSPKGYIEKLGQNLSNTNNVINVYFVPSDKVNPSITVGNYDHHTVYSGETFKNTINVNDNYGLNTVASTSDSTITMTRNNNELVGQAPNVTNSTNKIVKVKATDKSGNESIVSFTVNIKPLNEKYRITTSSNNQTPVRISNIQNNANLSIEDQNRVKSSLSMTKILGTRNYVNESNNDVRSQVVSKVNRSGNNATVNVTTTFSDGTTNTITVPVKHVLLEVVPTTRTTVRGQQFPTGKGTSPNDFFSLRTGGPVDARIVWVNNQGPDINSNQIGRDLTLHAEIFFDGETTPIRKDTTYKLSQSIPKQIYETTINGRFNSSGDAYPGNFVQAVNQYWPEHMDFRWAQGSGTPSSRNAGSFTKTVTVAYQNGQTENVNVLFKVKPNKPVIDSNSVISKGQLNGQQILVRNVPQNAQVTLYQSNGTVIPNTNTIIDSNGIATVTIQGTLPTGNITAKTSMTNNVTYTKQNSSGIASNTTEDISVFSETSDQVNVTAGMQAKNDGIKIIKGTNYNFNDFNSFISNIPAHSTLTWNEEPNSWKNNIGTTTKTVTATLPNHQGTRTVDIPITIYPTVTAKNPVRDQKGRNLTNGTDVYNYIIFENNNRLGGTASWKDNRQPDKNIAGVQNLIALVNYPGISTPLEVPVKVWVYNFDFPQPIYKIQVGDTFPKGTWAGYYKHLENGEELPIDGWKFYWNQRSTGTTSDQWQSLAYTRIPFVKTGTYDVVNPSNWGVWQTSQSAKFIVTNAKPNQPTITQSKTGDVTVTPGAVRNIQISGTNDYIQASADKIVINKNGNKLTTFVKNNDGRWSVETGSPDINGIGPTNNGTAISLSRLAVRPGDSIEAIATEGSGETISTSATSEIYIVKAPQPEQVATHTYDNGTFDILPDNSRNSLNPTERVEISYTEKLNGI

SEQ ID NO: 42066 - protein, 458 aa, Staphylococcus epidermidis BVS058A4
MKKSSKFSKDFPTRKNHYAIRKFTVGTASIIVGSFLFFGQTQAQAEEFERVTTGTVDTGGQPARADQGQEGPQAGADTHNTASQPGVTGQDAPNENHAGDQNAAVTHPADQENNAPQVGAGTPGAENTPQAGGENHNQENAVTSAGTNGEQNGGKPATSTTGQDAAQSNGPQGTSVAQPGNDASSQGHDTPQADAGTHNTEGQPAVTTGEQVGGKPAATKPEGASAETAPAPNNADENHAQPSPQTGGTTATQAGQVKPSGDSTPNGEPNKADDQGTQTKPTSNQGTTATTDETGNQKPSGQTGNTENTPNEGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPGTTPNQDAEVKPNPDQNNTPT

SEQ ID NO: 42067 - protein, 434 aa, Staphylococcus epidermidis BVS058A4; identical to SEQ ID NO: 39380

SEQ ID NO: 42068 - protein, 240 aa, Staphylococcus epidermidis FRI909
MKKRLLFVIVISLFIFSSNHTALSNGDVGPGNLRNFYTKYEYVNLKNVKDKNSPESHRLEYSYKNDTLYAEFDNEYITSDLKGKNVDVFGISYKDGSNSRTIYGGVTKAENNKLDSSRIIPINLNINGKHQTVTTKSVSTDKKMVTAQEIDVKLRKYLQDEFNIYGHNDTGKGKEYGTSSKFYSGFDKGSVVFHMNDGSNFSYDLFYTGYGLPESFLKIYKDNKTVDSTQFHLDVEISKK

SEQ ID NO: 42069 - protein, 266 aa, Staphylococcus epidermidis FRI909
MYKRLFVSRVILIFALILVIFIPNVLAESQPDPMPDDLHKSSEFTGTMGNMKYLYDDHYVSATKVKSVDKFLAHDLIYNINDKKLNNYDKVKTELLNEDLANKYKDEVVDVYGSNYYVNCYFSSKDNVGKVTSGKTCMYGGITKHEGNHFDNGNLQNVLIRVYENKRNTISFEVQTDKKSVTAQELDIKARNFLINKKNLYEFNSSPYETGYIKFIESNGNTFWYDMMPAPGDKFDQSKYLMIYKDNKMVDSKSVKIEVHLTTKNG

SEQ ID NO: 42070 - protein, 687 aa, Staphylococcus epidermidis FRI909
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTHPADQENNAPQAGVGTPGAENTPQAGGENHNQDNAVTAAGTSGEQNGGKPATSTTGQEAAQPNGPQGTSVAQPGNDASSQGHDTPQADAGTHNTEGQPAVTTGEQASGKPAATKPEGAGTETAPAPNTADESHAQPSPQSGGITATQAGQVKPSGDSTPTGKPNTADDQGTQIKPTSNQGTTVTTGETGNQKPSGQTGNTENTPNDGTQVKPNNDPAATGTPNANEEQTGQPNATVTPGQGNDEINGATKPGEVSPKPEENNPAVTEPGTTAPGNTNQGTQVKPNNNQTATGTQGATGDQNTQQGNTEQNNQNAEQGNTGQEGSNPNQSAQLGATVKPGSATNQDTEVKPNPDQNNNSTTGQDADQTGQGTQVKPNNNQTATGTQGATGDQNTQQGNTEQNNQNAEQGNTGQEGSNPNQNAQLGATVKPGSAPTQDTEVKPNPDQNNKPTTGQDADQTGQSTHVKPNNNQTATGTQDANGDQNTQQGNAGNKGNTGNAGNKGNTGNAGNKGNTGNAGNKGNTDKDAKVNTNDDETKTDVKNGTELPETGLSNEYDYTTTVFGSIALISSLLLLRRQRKESK

SEQ ID NO: 42071 - protein, 434 aa, Staphylococcus epidermidis FRI909; identical to SEQ ID NO: 39380

SEQ ID NO: 42072 - protein, 291 aa, Staphylococcus epidermidis FRI909
MKKIDSWLTKHGLKNRLTLVVIAIFIIFLILLFMFVNLSDEDTGQITITENAELRTGPNAAYPVIYKIDKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 42073 - protein, 3692 aa, Staphylococcus epidermidis FRI909
MNLFRKQKFSIRKFNIGIFSALIATVAFLAHPGQATASELEPSQNNDTTAQSDGGLENTFQSNPISDETTNTLSEQTVPSSTENKQTQNDPHHNNQPIAINAEEAESAQTPPYTNIYENNDTSDNGLHVNQPVKHHIEAQSEDVTNHTNSNHSNSSIPENKATTESSSKPKKRGKRSLDTNSGNDATSTTQNTDPNISNTGPNSVNTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGEQTPFSINVIMNKDDLSEQVNKDIIPSNYTLASYNKYNKLKERAQTVLDEETNNTPFNQRYSQTQIDDLLHELQTTLISRVSASREINDKAQEMTDGVYDSTELTTEEKDTLVDQIENHKNEISNNIDDELTDDGVERVKEAGLHTLESDTPHPVTKPNARQVVNNKAEQQKTLIRNNHEATTEEKNEAISQVEAHSSDAIAKIGEAETDTTVNEARDNGTRLIATDIPNPTKKAEAREAVTNSANSKIKDINNNTQATLDEKNDAITLVNRSKDEAIQNINTAQGNDDVTEAQNNGTNTIQQVPLTPVKRQNAIATINAKADEQKRLIQANNNATTEEKADAERKVNEALLTATQNISNALTNRDVDQAQTTGSGIISTISPATKIKEDARAAVEAKAIAQNQQINSNNMATTEEKQDALNQVEAHKQATIENINQAQSTQQVSEAKNNGITTINQDQPNAVKKNNTKTLLEQKGNEKKSAIAQTPDATTEEKQEAVSVVSQAVINGNNHINQANSNDDVDQALSNAEQIITHTDVNVQKKPQARQALIAKVNEKQSAINTDNEGTIEEKQKAIQSLNDAKNSADEQITQAASNQNVDNALNIGISNISKIQTNFTKKQQARDQVNQKFQEKEAELNSTPHATQDEKQDALTRLTQVKESTLNDINQAQTNQNVDTALTNGIQNIQNIQVDVRKKQEARTTINDIVQQHKQTIQNNDDATTEEKEVANNLVNVSQQNVISKIDNATTNNQIDGIVSDGRQTINAITPDTSIKRNAKNDIDGKAADRKIKIQRINDATAEEIQEANRKIEEAKIEAKDNIQHSSTRDQVNEAKTNGINKIENITPATTVKSEARQAVQNKANEQINHIQNTPDATNEEKQEAINRVNAELARVQAQINAEHTTQGVKNIKDDAITSLSRINAQVVEKESARNAIEQKSTQQTQFINDNENATDEEKEVANNLVIARKQNALDNINSLSSNSDIENAKVTGINEIAKVLPATTVKSKAKKDIDQKLAQQINQIQTHQTATIEEKEAAIQLANQKANEARTAIQNEHNNNGVAQAKSNGIHEIEIVTPDAHKKSDAKQSINDKYNEQSNTINTTPDATDEEKQKALDKLKIAKDIGDRKVDQAQTNQQVSDAKTEAIDTITNIQANVAKKPSARVELDSKFEDLKRQINATPDATEEEKQDAIQRLNVKREEVKNLINQDRRDNDVEQHKNTGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKEEARKLVEKAKTEVKSNIINSDTEREVNSAKTNGLEKINNIQPYTQTKTNAKQEINDKAQEQLIQINNTPDATEEEKQEATNRVNAGLAQAIQNINNAHSTQEVNESKTHSIATIKSILPNVIKKPTAINDLTQEANNQKTLIGNDGNATDDEKEAAKQLVTQKLNEEIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIELSTQTKTQAKADIAQAIGQQRSTIDQNQNATTEEKQEALERLNHDTNGVNDRIQAALANQNVTDEKNNILETIRNVEPIVVVKPKSNENIRKKAAEQTTLINQNQDATLEEKQIALGKLEEVKNEALNQVSQAHSNNDVKIAENNGIAKISEVHPETNIKRNAKQEIEQVAQSQIDTINTNNKSTNEEKSAAIDRVNVAKIDAINSITNATTTQLVNDAKNSGNTSITQILPSTAVKTNALVALATEAKNKNAIIDQTPNATAEEKEEANNKVDGLQEESDANILKAQTTEEVNNIKNQAVQNINAVQVEVIKKQNVKNQLNQFIDNQKKIIENTPDATLEEKSEANRLLQNVLTSASDEIANVDHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQPHPQTKATGRHRLNEKANQQQSTIATHPNSTIEERQEASTKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVVEIVKAQQNKIDEIEQEFSATQEEKDNALQHLDEQVKEIINSINQANTDNEVDNAKTSGLNNITEYRLEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTPDVTHEERNDAINHVKEQLSLVFNAIEKDRKDIQVAQDELFGLNELNSIFINITQKPTARKAISDKASQLNKSINNTPYATEEERQIALNKVKAIVDDANEKIREANTDSEVLGTKSNTITLLQAISADVQVKPQAFEEINAQAEIQRERINGNSDATREEKEEALKQVDTLVNHSFITINNVNKNQEVYDTKNKTIEAIHKIKPISTIKPQALNEITIQLDAQRDLIKNNKESTVEEKASAIDKLIKYAARIAEAIDKAQTNEEVKDIKKQSIDEISKILPVIEIKSAARNEIHQKAEVIRGLINDNEEATKEEKNVALNQLDTTLTQANLSIDQALTNEAVNRAKEIATSEINKISVIAIKKPEAIAEIQKLADKKLNKFKQNQEATIEEKQSAVNELEQALKSAINHIHQSQNNESVSAALKESISLIDSIEIQAHKKLEAKAYIDGYSDDRINDISSRATNEEKQIFVSKLKALINRAHKQIDEAETIVSVDTIVRNFKVEVDKLNSIVRKKAKALKEIKLEADHVKQMINANLSASTRVKQNAHTLINEIVSNALSQLNKVTTNKEVDEIVNETIEKLKSIQLREDKILSSQGSTTSMTEKSNQCYSSENNTIKSLPETGNVDKSVPLAGVTLISGLAIMSSRKKKKDKKVID

SEQ ID NO: 42074 - protein, 355 aa, Staphylococcus epidermidis FRI909
MKDIKPNNSKLIQTYLSKKTIRYGTASALTLALYLFNSNVTVYADENTANQGTSPKTSQTAPTNNNENTDATAVTTDQNNNDEEEYDASYELPILYVTVWLDDQGNIIKDAVEDAKTPASERQPVKIPGYQHYRTSVSDGITKFIYRKISTEQSPIVENSQQNNNTNKVVETTNQNKDEVNGKEQNQANTSVTNTQITKNEKDEDTKTLQKDKDEKESKDTKTPKKDKENKDTKTPKKDREEKKPVITSNGKDEKDEDRKTPKKDKEEKITKTSKKDREEKSPAIPKSDIDEKDTKITKKDKVDEITTTSKKDNNNDVQDKLPETGKSNDIQNPALIMLLAGLGLLGLFRNKIRE

SEQ ID NO: 42075 - protein, 688 aa, Staphylococcus epidermidis FRI909; identical to SEQ ID NO: 41926

SEQ ID NO: 42076 - protein, 728 aa, Staphylococcus epidermidis FRI909
MKNKKNSYSIRKLSVGASSIIVTSMLFIGGGSVHAAESNQLENQEQSEVSASHSIELQHKDQEIQQPENKDNKNYHSETIDKNPTIHNNDYSYHETPSTDVKSNESKQIDNQSNQPQTSMTKNDQQNPKKVAEHTTKGINAKKEETRKNENAKSLVQPQQDDKTTSEQTKMKESREQDITNEQKQLQSKDVKNAQQENQNIDQEKSQEKINLQQSSIDKAQKSSRIDGKLDHQYNKDATQSNEDTASENVSEQHITAKDAGVTRNNRGDERLNQEKSTTSSDKELKVDDIDKDLSTKESPENEKDDSRKGIKALTKNSQATTRNTATTEASKELKDQTNKVASQKEYKNHDPIILVHGFNGYASGTGPITGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42077 - protein, 235 aa, Staphylococcus epidermidis FRI909
MKKTVIASTLAVSLGIAGYGLSGHEAHASETTNVDKAHLVDLAQHNPEELNAKPVQAGAYDIHFVDNGYQYNFTSNGSEWSWSYTVAGSDADYTESSSNQEVSENAQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVDDQINAAYKAYKAQGLSAWGM

SEQ ID NO: 42078 - protein, 327 aa, Staphylococcus epidermidis FRI909
MNWQRKCILTTLLVLSSLFLVFSTITYASERDYKDSLKITTHNVYFLPTAIYPNWGQSQRADLISKADYIQNQDVVILNELFDKKASKRLLARLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSEEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42079 - protein, 681 aa, Staphylococcus epidermidis FRI909
MKNNNRIKRFSIRKYAVGVVSIITGVTIFIGGQQAQAAEISVQYADAHPEDSQTTQQLKNDKVEETLKASKQGTADSQKVQTIDQSKTNQNNQHSVAESAQLKSDETANQPKVEEESSVKQDVQPSKNVNQQDVATQSNERENNDIKGEDQTSKASNQHTQSSNSHNQSIGTKDSDSEEIDQPLVKLQKPSNDSTYQTQSKAKQDSSKQLPQEKTTKHQIQTTENEQTTNVDSKKANDTQDARQHTQEPKNDTSTSQKNHHQVATKEQSNRSTTRETQKQSANSNQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFIGGKDNMVASITTLGTPHNGTPAADKIGTRKLVKETINRIGRLSGGKDVDIDLGFSQWGLKQQPNESYIDYAERVYKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKQVDDHTPATDKGVWQVRPVQHDWDHLDLVGMDAFDLTHTGRELGQFYLGIMDNIMRIEEADGITNK

SEQ ID NO: 42080 - protein, 219 aa, Staphylococcus epidermidis FRI909; identical to SEQ ID NO: 42003

SEQ ID NO: 42081 - protein, 240 aa, Staphylococcus epidermidis M23864:W1
MKKTLIASSLAVGLGVVAGNAGHDAHASEATNVDKAELAQKAQSNDQSLNESPIQEGAYNVTFDYNGFTYHFESDGNNWSWNYAQTGQATPQQDVSEQASASNNQTSAEQVSAQQQSNQAQPEQTAAPQTEQTQQPQAKATTSYSAPSNNTSSSKASSGSSVNVNSHLQQIAQRESGGDIHAINPSSGAAGKYQFLQSTWDSVAPSQYKGQSPANAPESVQDAAAVKLYNTAGANQWVTA

SEQ ID NO: 42082 - protein, 1983 aa, Staphylococcus epidermidis M23864:W1
MKKNNRIYNLDNTITRFSIRKYQGFGAASVAVAAFFMMTNTHFAKADVSDSKETNDQIQTQSNLNQTNDLTKESTPITKVNNVNNEQKNPEPVTTQNSVDKSKLNQLVAQYKAIDLSPKTEESIKAFEADVNEAERVLNSNLTQQEVNRFYYKFLNSAGKLRNKTTMDSNDLTNNDNQRTQNKETIHTPPRTRINTNSQPKHLPHGSYFRAVDTAANTVASTDPLSKNETDASIKNGNFRQVSGGNLPTRSNKLTIVRGVDHWHSLSKDPNPEYPILFTPAAKDYANFMSDNTDPYGVVLARTTNGWDRSVLDPRVAGIYQDIDVTPGSELVINFISTSPTFTDGVTGAKLKISNVEGTQTLFDKRLDAMQNFPTGWLKAMVNIPDNMNQVRISFLPISINNALTTRESNSGHGFGDNPNYNYGGTVSRVTANTGAYVVSRINQVNYDAVASTPTSNVARATVSLTVENKGHTQSKETTYKVVLPPNSKFISATGANGNYNANTNTLTLNISNIHGGNTKDISYTVEFEAMRPKLVDLNGQISYKTNAPFRGDGSQKTGNNSVNTQTVTLKMNKTDLESKLTEVEAHIRDLKESNYTNQSWNALKEKIAEARTIINEDNNNVALDNRASQATINTVTNELVTLKGELKMATPSKPIVNANNQEANVTISPALEADKVNISYHNTNNENDTLVATKSNATWSLDKQVQGITINENTGKITISYSAVQSESLITATETTGNSADSELSEITMPRKETTPGAPTIKADQTNATVTVIPVGESTKIVIKYKNKENQAGEIIATKTGSTWSLNKQETGITIDANSGDVTISYSAVHPESEVTASETKGNSDMSPESKVNMPRKEQTPVPPIVNANEAQANVNIAPNGESTKVVVQYINNGGQASTVTATKEGTTWSLDKDVSGISINSNSGQVTISHLAVQPESEVTASETKGNSDASQEIKVKMPRKESTPQAPTISTNEEQASVIVTPSDDSTKMVIKYLDLEDQINSITASKINHQWSLNKQVQGITIEPNTGKVEISYQATQPESDIIATETKGNSDESGESKTVMPRKEDIPEPPTVSANVEQANVNVVPNDDSTKVIVNYTNTEGQIISINANKEGTAWRLDKQEEGITINENTGELTISYTAAQPESEVTASEIKGNSDASALSKVKMPRKESTPEAPTVNTDDVETNVSILPNDESTKLEINFKNKEGQSSKITATKEGGIWNLDKEVPGITIEPTTGEVTISYTAVQPESEVIASETKGNSEASEVSKVAMPRKESTPSAPTVKADVSLANVSILPNNESTKVIVQFINKDGKLETAITTKEGAIWSIDKEVPGITLDTTTGEVIISHTAVQAESEVTASETKGNSDSSGLNKVTMPRKESTPDAPTVNANEAQANVSILPNGESTKLEINFTNKEGQTTTVIATKEEQNWILDKEVPGITLDTNTGEVSISYTAVQPESEITASETKGNSEASQTSKVTMPRKEQTPPAPTIIADVERASVSVIPNDESTKVVIKYLDLEDQISTITASKINHQWSLNKVVPGITIEPNSGKVEISYQATQPESDIIATEIKGNSDESGEGKTVMPRKESTPEPPTVSANEMQASVSIVPAVESDKLKVHYTNKDGQASILIATKEGSTWTLDKQESGITLDTNTGEVTISYSAVQPESEITASETKANSDESEVSKVTMPRKESTPEAPTVNANEAQANVSILPNDDSTKLEIHYTNKDGQASAIIVTKEGTSWILDTEVPGISINPNTGEITISYTAVQPESEVTASETKGNSDASESSKVTMPRKEATPEPPIVSANDKEATVTVKPNDGATKVEIQIIDKKGKAIQITVNKKEALWSINENINGISLDSITGKVTISSETVEAGSVISTVEYRGNSDRSKVINIKMPQKLINKEKNKTNTSKVKTKAHISEKGKEKSKTKSKPKTNKALPDTGETNETNRTLISSILLIGLILIRKSRKKKDTI

SEQ ID NO: 42083 - protein, 72 aa, Staphylococcus epidermidis M23864:W1
HHETPGTPSHQDYSTPTHHETNHHSHHAKEKGLPDTGNDDSTHNVTLFGGLLALLGSLFFFGNKRRNRKDEH

SEQ ID NO: 42084 - protein, 641 aa, Staphylococcus epidermidis M23864:W1
MDFVPNRHNKYSIRRFTVGTASILVGATIIFGVDHEAKAAEHSTDTASLTSNNEEASNSSPVGQLGDTQKKTHTTQNNHNVQQLDNQSDEVGTSLKAQNNDVQSAEKTSTETSKEVMQNHTRNAKDLSGDAQSTDNTTEKQQEVENNNSNQETLTTNNQTTKNTHKVSRDEDVEQLNKQSTNHNVKETEQTVQTTKAQNPELQASAKQNSQSQTSQTSKRVSPQEQVTETYSPQDSASTRNQSTQKSVNKVNGLNNSNTRHHSLSNSPIDDQANEKNAIQVQATPRTVSRFAQPVSRAATNEANSEQQGSNVNDKINVDSFNVSKKSFDPNHSGYSDLNASFSVNGKIKEGDYFTVKYPQRVTVNGDVNYEKLNNQMKVKPLTNANGDVVANGIYDVNSKTVKYTFTNFVNDRNNIKGNFKLPIFTDRKNTPHSGSYSSTFNIADKNYTETLNISYDSPYQGIKDAYGPNISSFITDIDLHSGSEDFKQKIYVNPMENTLYNSNVRIQGYQTDQSKSSTIIDKNTKFKIYQVKDASQLSESYYNDTNSSNLVDVTNNFNGWITYNSDNSVNIQFGHIDGAYIIEVEGKYDSKSGQNVKTRVSETNDTVSGVRRQFYWDNENIVKPTDGSADGDLVVGSDSD

SEQ ID NO: 42085 - protein, 740 aa, Staphylococcus epidermidis M23864:W1
METRKNKYSIRKFSVGTSSILIAALLFIGGNSAQAAEENHNQGTSDNEISQSIGTNNENVNEHQTTKNEETQSTSEQPNVKNDTNDKTNQQNSLHNENNQKDVHQNTDNEESATSQNQAQEQSTGNQGHQQSDSKEDVKQPSTTDDARKTDQTSTENTKEKAQNQNAKTEAEDAAPMEKAEHHESADNQTQIPSKTENKSDNQGNQVSESETQDKQQTKENAQNSKDEDAQTLTKENTDETKSSKDTDDTTATVKSPKATSQKDNQPEADNHQKVTAQDDATSEATLATTKDSDESKSLTVGDNANPTSNKDDSSDKDKDSKDGLGTLKNNAVATTNKKSKQQTTQQNKDQTNKKAKHSQYKNHDPIILVHGFNGFTDDINPTVLSHYWGGDKMNIRQDLEENGYEAYEASISAFSSNYDRAVELYYYIKGGRVDYGAAHAARYGHKRYGKTYEGVYKDWKPGQKVHLVGHSMGGQTIRQLEELLRHGNPEEVEYQKEHGGTISPLYKGNNDNMVSSITTLASPHNGTHASDELGNEALVRQVVFDVGKAFGRKNSRVDFGLAQWGLKQKPNESYIDYAKRVQNSKLWKSQDNGFYDLTRDGATDLNRKTSLNPNIVYKTYTGESTHASLFGRQKADYNLFFPFTITANVIGKATEKEWRENDGLVSVISAQHPFNQKYVKATDKNQKGVWQVTPVKHDWDHVDFVGQDSSDTVRTREELQQFWHNLADDLVQSEQLTSN

SEQ ID NO: 42086 - protein, 727 aa, Staphylococcus epidermidis M23864:W1
MKNRKNSYSIRKLSIGASSIIVASMLFIGGQTAHAAEQDAQGNSENHIAQSIGAENDKNSEKQSNVENDNKSSLETKNNAPSSIHNEDAQQQAQTNTENNDKVTETKENATQDKQNQDNVKTNKSETQQPQIQQSQSSQTKNDHVSSQAQENQQNPNEQSQQTKQASAEKVSERKAEPQSEDTQKPSTSNTNVTKSSEKGNNDATKPLEKQDNDSVTQAQPQKKSHPASTQNNDSNHTQSPKQQVTAKDTQNAKKEAPVEALNKHPQTKAPQKQTTQKLTNQKDLKVKDLDSDGMTNTHAPGKKDDQSKKGLNTLTRNAVATPKNKSAQQTDKQVKKQANKSFPQIQYKNHDPIILVHGFNGYTADNGPALAGNYWGGDRIKLTQELRAKGYNVSEASVSAFGSNYDRAVELYYYIKGGKVDYGAAHAAKYGHDRYGKTYAGAYREWQPGQKIHLIGHSMGGQTVRLLEEMLRNGNPEEVDYQKQHGGSISPLFKGGQDNMISSITTLAAPHNGTHAADVGNEPFIRQLAYDYARFQGHKLSRVDLGLKQWGLAQRDGETHAQYVKRVNNTSKIWKTKDNAFYDLSREGTSKLNQHTSLNPNIVYKTYTGESTRPTLDGRQKADINIKFSYLVTANVIGKAPEKEWRVNDGLVSVISAQHPFNQAFVPATKEIKKGVWQVMPVKHGWDHGDFVGSDSSEVRISVDDLRDFWDSMMKEIVQNEKVTDK

SEQ ID NO: 42087 - protein, 528 aa, Staphylococcus epidermidis M23864:W1
MIKQHKFSIRKFAVGASSIVIGGIIFLSGHEDVSAAEQHSQTEGVHATTSSGNDETQVSDKESEINSINGKDVLTVSTKKPPKLSSQRSSSKLATTVPHSLNQSEPNQGSSDHDTIAPQIIDVDIDKHTYAPGETVKARVTIKEAGQLSDVSIGFSNDTRVGTSSINEIAKPENMHKGQDGLWTVDINLKIPDKIGDTSFSFAAVVADDASGNGDTVAPGLAPSSMNTDHLKFNIKNKEAVDTEAPQILGVTVDKKQYYPGNTIHARVHIKDASQLKEVSLGFVNAPYIGLDGINKFAYAKDMTRLPDGTWMADIALQIPKNIAASTYKFSHVSAEDEYGNITAVVDELSEPTNYTNLSFKILPMNESTQDHLSSTQPNLGASSENDYSNTDINNKDDRKIESSKHESKDDSTSNELEYQPLKSNKNSESFKGVKLATTTRENPQVNKKVRDDSETPQSHQDDTKTSISAPHEKAKYEYKEESKTEKQDQNLPQAGKTTKSIISFIAAILLIIGSIFILRREKRRTIK

SEQ ID NO: 42088 - protein, 1002 aa, Staphylococcus epidermidis M23864:W1
ETETKFTIKVVDTTKPMVTSIANQTKEVNTSIDSIKIEASDNSGQVVTNKVSGLPDGVSFDNETNTISGTPTKVGSYPITVTTTDASGNETTTSFTIQVVDKTAPMVTAINNQSKEVNTPIDKITIEATDNNGQAVTNKVSGLPTGVTFDSATNTITGTPTKVGSYPITVTTTDAEGNATTTNFTIKVVDTTKPTVTAIKDQTKEINTAIDSIKIEARDNSGQAVTNKVSGLPEGVSFDSATNTISGTPTKVGSYLITVTTTDAEGNATTTNFTIKVVDTTPPVVKSIANQTIEVNTAMDTITIEASDNSGQAVTNKVSGLPDGVIYNSQTNAISFAPRMHSSNLVKMKAMSIANNKTGTISGIPTKIGTYPITVTTTDAEGNETITQFIIKVVDTTAPVVTPIKNQTKEINTILDPIKVEATDNSGQSVTNKISGLPDGVSFDSATNTITGTPTKVGSYPITVTTTDASGNETTSNFTIKIVDTTKPTVTSIANQTKEVNTPIDSIKIEAKDNSGQKVTNKVSGLPEGVSFDSETNTISGTPTKVGSYPITVTTTDAEGNETTTKFTVEVVDTTKPTVTSIANQTKEVNTAINSIKIEATDNSGQKVTNKVSGLPEGVSFDSETNTISGTPTKVGNYPITVITTDAEGNETTTNFIIKVVDTTAPPAPAINPIKEGAKEISGKAEPGSTVVITFPDGQTAEGKADTDGNYHIEVPTDEHLKGGDHISVTSTDTSGNTSKATIITVIDTTAPPAPTINPIKEGAKEISGKAEPGSTVVITFPDGQTAEGKADSDGNYHIEVPTDEHLKGGDHISVTATDTSGNISKPSDAIVEGIHKHGKGDKPDDSNHHNGNNAKPDNPNHHDGVNPEPNKHNNSKGSNNHHVEKPSHNEHVNHPDKSQSNNDDNQTNGNQSKPSYTHHNEHQKINGATNTSNNQEEQPIQSQRDHSKANYGKNNSETDLPETGEEKGSKGILFGSLFAGLGALLLLFKRRRKDEDNNEKE

SEQ ID NO: 42089 - protein, 2845 aa, Staphylococcus epidermidis M23864:W1
MKNKQGFLPNVLNKYAIRKFTVGTASLLIGATLVFGVGGVARADEIDNATSQNGNSTKDKSEPVDVEELSNSDNTTNQSVKETSDQTTNQVNENQSLDQETNTTESKTNETQSSESVTNENASEESKSDVSDNKTTTNDNNKANDTVKGSQQQPKEETNESTKATENNKDTTERKDNISEESVNTDSTKESTSEKSIVNNKSSNQTTEQSKDTDSTSSSKTTDKSTDTDITSSKTSEQNSNIDSTSSKSNTSNETTETNTVGSSTNATTPIEDTTKIESKKESSIPLSDNKTSLTNQVTATTTTRNNNKRFRVLVATKDTKAKTYTKPSNPNYAYLLNDLGYDATTIKDNSGLRYAGVSQLQNDTGNVIKLNLTNWIENNDLIDGGKVNFSFSQSDFYSQIQNITINGVYMTTTNNGQNWTAPINGKTVEGTEGIVTNNEVLITLKNSQTIASLGYSNSKPVYLTHTWTTNTGAIAGESVQVTTIAPNIYSKAPQTTQSSGFTSGKVVNRIRYDSSDNSIKSIHAFKPDENFLQTDYNWVLYIKEQVNKDLIPYIDPSSVKIYVSDVKGDPISSSRFVNGTLSSDGMFDSSTIDEISIKNTNTLMHLNDARGSLDRNIFYGALGQSRNYTIQYKLKSGYTLESIASQISDRETFQSWIETDYLDTADNGSANKRLLGSYATSYIDMIDRIAPVAPKASNITTQDTAIKGTAEANTTITLNFSDGRTLSGTADSTGNFSVSVPSGFVLTGKETISITSTDKGSNVSPAITITVTDTTPPTVTAINDKTQEVNSVLNNININASDNSGDTVINTVSGLPSGVTFNASTNTISGTPTKVGSYPITVTSKDTNGNTTTTTFTIKVVDTTPPVVKTIVDQTKEVNTSIDSIKIEATDNSGLAVGNTVSGLPNGVSFDSNTNTISGTPTKVGSYPITVTTTDASGNVTKTTFTIKVVDTISPVVTSIADQSNEVNTAIDSIKIEATDNSGLAVSNTVSGLPNGVTFDSNTNTISGTPTKVGSYLITVTTTDAEGNKTETNFTIKVVDTTKPTVTSIEDQSKEVNTPIDSITIEATDNSGQGVTNKVNGLPDGVTFDSATNTISGTPTKVGSYPIVITTTDASGNETTTSFTIKVVDTTKPTVTSIEDQTKEVNTPVDSIKIEATDNSGLAVSNKVSGLPEGVSFDSETNTISGTPTKVGSYPITVTTTDASGNETTTSFTIEVVDTTKPTVTSIKDQTNEVNTPVDSITIEATDNSGQAVTNKVSGLPEGVSFDSTTNTISGTPTKVGSYPITVTTTDAEGNATTTSFTIKVVDTTKPTVTAIKDQTKEVNTAIDSITIDATDNSGQAVTNKVSGLPAGVEFDSETNTISGTPTKVGSYPIVVTTTDESGNETTTKFTIQVVDTTKPTVTSIGNQTKEVNTAIDSITIDASDNSGQDVTNKVSGLPDGVSFDSETNTISGTPTKVGSYPITVITTDASGNKIETTFTIEVVDKTAPMVTSIKDQTKEVNTSIDPIKIEATDNSGQAVTNTVSGLPEGVSFDSETNTISGTPTKVGSYPITVTTTDASGNETTTSFTIEVVDKTAPMVTSIKDQTKEVNTSIDPIKIEATDNSGQAVTNKVSGLPDGVSFDSATNTISGTPTKVGSYPITVTTTDASGNETTTNFTIKVVDTTKPTVTSIGNQTKEVNTAIDSIKIESTDNSGQAVTNKVSGLPDGISFNSETNTISGTPTKVGSYPITVTTIDAEGNATTTNFTIKAVDTTKPTVTSIEDQTKEVNTAIDSIIIEATDNSGQAVTNKVSGLPEGVTFDSETNAISGTPTKVGSYPITVTTTDAEGNATTTNFIIKVVDTTKPTVTSIEDQTKEVNTPIDSITVEATDNSGQAVTNKVSGLPEGVSFDSATNTIKGTPTKVGSYPIVITTTDASGNETTTSFTIKVVDTTKPTVTSIKDQTKEVNTAIDSIIIEATDNSGQAVTNKVSGLPEGVSFDSTTNTISGTPTKVGSYPIVVTTTDAEGNATTTNFTIKVVDTTKPTVTSIEDQTKEVNTPIDSITIEATDNSGQAVTSKVSGLPEGVSFDSETNTISGTPTKVGSYPIVVTTTDASGNKTETKFTIEVVDKTAPTVTAIKDQTKEVNTSIDPIKIEATDNSGQAVTNKVSGLPAGVSFDSETNTISGTPTKVGSYPITVTTTDASGNKIETTFTIEVVDKTAPAVTFIEDQSKEVNTSIEPIKIEATDNSGQAVTNKVSGLPAGVEFDSETNTISGTPTKVGNYPITVTTTDASGNEMTTKFTIEVVDTTKPTVTSIKDQTKEVNTAIDPITIDASDNSGQVVTNKVSGLPEGVSFDSVTNTISGTPTKVGSYPITVTTTDESGNKTTTNFTIKVVDTTKPTVTAIKDQTKEVNTSIDPIKIETSDNSGQAVTNKVSGLPSGVSFDSTTNTISGTPTKVGSYPITVTTTDESGNETTTKFTIQVVDTIKPMVTSIEDQTKEVNTPVDSITIEATDNSGLAVSNKVSGLPEGVSFDSATNTISGTPTKVGSYPITVTTTDAEGNATTTNFTIKVVDTTKPTVTSIKDQSKEVNTSIEPIKIEATDNSGQAVTNKVSGLPEGVSFDSETNTISGTPTKVGSYPIIVTTTDAEGNATTTSFTIKVVDTTKPTVATIKDQTKEVNTAIDSITIDASDNSGQAVTNKVSGLPAGVSFDSATNTISGMPTKVGSYPITVTTTDAEGNATTTNFTIKVVDTTKPTVTAIKDQTKEVNTSIDPIKIEATDNSGQAVTNKVSGLPDGVSFDSATNTISGTPTKVGSYPITVTTTDASGNKIETTFTIEVVDKTAPTVTAIKDQTKEVNTAIDSIT

SEQ ID NO: 42090 - protein, 329 aa, Staphylococcus epidermidis M23864:W1
MRYLNWSRKCIVTTIFVLSSLLLVFSSITYAKERNSEDSLKITTHNVYFLPTAIYPNWGQSQRADLISKADYIQGQDVVIFNELFDKKASHRLLTNLQSQYPYQTPIVGKGIEGWQKTSGSYRKVKQVSGGVGIVSKWPIVQQEQHIYKDGCGADKLSNKGFAYIKINKNGKYHHIIGTHLQAEDPTCMKGKDQSIRQSQMNEIKQFIKDKHIPKNEPVYIGGDLNVIKGSDEYQQMPDNLNVSLPTQFEGNPYSWDTQSNSIAKYNYPKLEPQHLDYILLDRDHAQPSSWHNYVHKTKAPEWSVKSWGKTYKYNDYSDHYPLSAYASN

SEQ ID NO: 42091 - protein, 1562 aa, Staphylococcus epidermidis M23864:W1
MKLKTKYRFSIRKFSIGTGSVLLGAFLFVGFQDVAHADEIHNNTSLQLGDTTSKPQPLENEVTKSSNSEISTQTPTTNTTQSENTSNTKETDSHITSEKPKQITDNTNAQTTASSSTTNKQKVHTRVRRSATSPITSEGVLTDHATIATPNMDNPNGATVKNREVVTPQPKNSNTTPTPNVVFEANPDPNQYTIAITDLTNFNTTYHTKYYYRLSKPYDDSDDITIQLVDGVNNSIVETKSINADGVVTFGENSLAHVVATQDPNKAKYALLDFTFLHTLNQFKQTVPAIKVQFKSDKNGNLGNQRTSLRIFDVYNSANEGNTSPDPQYFIPITASLTTHYRVINKNNPTFQADKNDINTQTYEPDHTEQELAHYTIQGMGGQTYTASNVRRFKGYKLYQTVSPDNMSGTLISAYPVGLRYVDATNSNGGIKRIKEVVGEDGTTRVEIWTLSIDHMSEAAKSTGIDTTNYVRVYAETLKPGERNMEHLGEYIDIPGYPKPFKIQPASEGDAAGMLFAPKQVINGVQVGSGGNFRLQNFLARIKPADYYYTTLDPVEVTLKVHNIIKGDHNQTPGEFTFNIEAGPHSPTIPDASQSKTNAEDGSVTFDKIAFTKPGTYTYTITENKTNLNPNYDAEPLRVTATITVIEEDEMLKANVVYSYDGDNDGNQAFTNYYVEPQPFDLNIPFTKSLTGRNLKDGEFHFALKNDKEEVLATGVNDAQGAINFTFLDGKRPTYTNADVGHTFKYNVEEVPSNEERMTSDPMKAVISVNVLKFENTELHALTVTSIAPLDTEFNNTYTPLPATAKLEFTNVLDGKPLTDGEFQFTLSEGDHVLQTVSNQNGKVTFDHLTYNSVGSHTYTVKEVPGTDTNIDYDPMAATVTVNVTKDPVTGNYEATIVNPNDTEFNNYFVSPIALSFDFSKKLLNRPLKADEFEFTLKNEQGVEVARTKNTIDGKVIFNNISFKNSDVGTHTYTVEELQGNDPNITYDNMKAIVKISISKEGHILQSKTELPTDTEFNNTYIPLPATAKLEFNNVLLTGKPLTDGEFQFTLSEGDHVLQTATNQNGKVTFDHLTYNSEGSHTYTVKEVPGTDTNIDYDSAVATVTVNVTKNPITGNYEAVIVNPDDTEFTNYYVNPIALSFDFSKELLGRPLKADEFDFVLKNEQGKEVARTKNTVDGKVIFNNITFKNSDVGTHTYTVEELQRNNPNITYDSMKANVKISITKEGHILISKTELPADTEFNNTYIPLPAIAKLVFNNVLTGKPLTNGEFQFTLSEGDHVLQTVSNQNGKVIFDHLTYDSEGSHTYTIKELQGTDTNIDYDPMVATVTVNVVKNHLSGNYEAVIVNPNDTEFNNYYVSPVSLSLDFSKKLIGRPLKAHEFDFVLKDEQGKEVARTKNTIDGKVIFNNLTFENNDIGTYTYTIEELQGNDSNITYDHMKAKVKITITKEGHILISKTELPADIEFNNTFTPVKTPTPNKVPLPKPQKTSEHKVEYDKKAKYNKEIELMKETKFNKYNEVHKVASLPDTGISDKNNDKTLFATVFTVLGSLILLGRRRRKSKSI

SEQ ID NO: 42092 - protein, 709 aa, Staphylococcus epidermidis M23864:W1
MENYKEKNRFSIRKYAVGAISIITGVAIFIGGHQAQAAEDTHQNVDKPTQTQELTQSVQKENQSTEASESSTEKTQVQSPNQQAQVTTKHNDEQMKEASNQNLNEADNPKQIDSKKEEPATHQDAVPSKKTDDATHQKEPSTNHQSQEPPENEYSVQKNVSDNTESNKNNQDSQTQQATNSGKNTYSKEPEQSQDTTQQKAKEQESQNDSKKKEKQVDKGEKQPSQNLQQSAENNESKVDKPKKGEQIQTKSSNTNHNSLNQNKEKEKHQQTIQSTNNKEEIPKPSKQTTKANKKSASQSSQSSQSLQSKQSNKLPKKAAQAQYKNQYPVIFVHGFVGLVGEDSFDLYPNYWGGKKYNVKEKLTEQGYRVHEANVGAFSSNYDRAVELYYYIKGGRVDYGAAHAAKYGHNRYGRTYKGIIPDWEPGKKVHLVGHSMGGQTIRLMEHFLRNGNQEEIDYQREHGGTLSDLFKGGKDNMISSITTLGTPHNGTPAADKLGTRKFVKNTINRIGRIGGSKALNLNLGFAQWGFKQKPNESYAEYAKRIANSKVWDTEDQAITDLTSPGAEKLNQMTTLNPNIVYTSYTGAATHTGPLGNEVPNVRQFFLFDLTSRVIGSDENKDRRVNDGIVPVTSSLHPTNQAFKKVGLMNPATDKGIWQVRPVQYNWDHLDFVGLDDTDYKRDGKELGEFYQSLINNMMRVEEKDGVAKK

SEQ ID NO: 42093 - protein, 434 aa, Staphylococcus epidermidis M23864:W1
MPIITDVYAREVLDSRGNPTVEVEVLTESGAFGRALVPSGASTGEHEAVELRDGDKSRYLGKGVTKAVENVNEIIAPEIVEGEFSVLDQVSIDKMMIQLDGTSNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPKFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSRGIEQGIGNSILIKVNQIGTLTETFDAIEMAQKAGYTAVVSHRSGETEDTTIADIAVATNAGQIKTGSLSRTDRIAKYNQLLRIEDELYETAKFDGIKSFYNLDK

SEQ ID NO: 42094 - protein, 718 aa, Staphylococcus epidermidis M23864:W1
MNKHQKNHTLRYANYFSIRKLTVGVASITLGTALFLSSSHDAQAAENSSTQSDTKTTTTTGQNSDGTPPTGTATTTNTSNHKNQADSSQNQNNIQPSTTPTNNSSSQTTTKPNSQSDKKITAKDYQATTYKNLYDDVVYDKSKLHKELPLFVSGHFRNAMNNEETSLYEGALNPNVKIEKVNDLYKYTVRLHPGIADVGGEFYDFDLFKMEYKDQPLELRTINDKNRIKEFSVTSKDLLEKIQLTGTTKYPENVNNPSKGRDQAHDVTLQLYYDSARKFNDALWNDPKEVPSKPAKPAKATPSTTQTKPANQTTASTQSSVADHEVEANKVPNAYPVTIQGELKYQKDNSQTSTYANLFEKDVKVEKDGDKFKYTFKVKEANGNTLITKRTKYQFSKITHNGENVLLTEQADKVKEAVLTTDKLLDKIQLKTTVVSKYDKAGNEVDTTLDLDFPIVEKPQTDTTNNATTNTTEVTPVKTEFENATPTPTVLKDEKAVDFSVLKSLKDQPSVLENYIQKPFKVAVDEKGNQLVVLTLNNDSYWKEFKVEGTRATTIAKDKEHDTRTITFPYVEGKKVYQAFVSVEVPKIGYKGNYKIRIVNNDPKKEPEKVSERIPNKEPETPHMKDPNKTPTTPTHKKETIKITKKDETKVKGKKTTNDDKSSTKNKKHETKHQSDKSKTLPNTGVDTTTPTIWASVLSFFAGVLLLKRQTRKSNKKH

SEQ ID NO: 42095 - protein, 493 aa, Staphylococcus epidermidis M23864:W1
MKKQHRKNTFIFKNNFSIRKLKFGVASITLGSALIIGAHQEAKADENSGNQNDNVSTNQNVQNKDQSTQQVQNQPKNTSATQNSNTQNNQPTTVQDQNAQANNTKSDSSQSAGLSESLNFQVQKDKTNEVSHMDQYVQHPGKVIKKNDKYYFQITLENASWWKSFQFFDESETELPTTVVDDNTEKDTKTVNIEVTPGMNNIISKVHIVIPALKYDHEYTTHIELESVIPTIEDPEPTTPQEQPKQNDTTQDQQPATDKTESSTPEKPSTSVSNTETQKQDTKVDAQSKQDETSKNQQPATDKTESSTPEKPTTSVNNTETQKQDVKAETPSETGKKDDNKVEKPTTTQTDTTSKQNKSTTNPSEKDRKDKKDKQPKKDKKVKQPKKDVKNPVTGGKTGKDSGKGSKNGKGDDKDRKGVKKEKGNDKDYKNNQVSKTDTVKDSKVNKNDSDSKSTNELPQTGSHKESNNGVIFSLIALFSSLFFIKRKSNKNI

SEQ ID NO: 42096 - protein, 752 aa, Staphylococcus epidermidis M23864:W1
MNKPNHFSNNTPTKKNHYSIRKFTVGTASIIVGSFLFFGQAHAEENPQGTTGTGFQRETVGTVETTGQPAAGNPGTATPAQGAQNDQNNQAGGAQTGTPNNAQDTGAPAQAKPEAGTTPAGNQAEQNAGTPQNNQADASVTPAQSAGQQGQGTPGADQNATTGQQTGTAAQGADTKPGENGAGTAVTPAPTTGNNNQQDQAGATGGTPAKPDTTAGQDTAKPGNTDASQTPGNNQQGQDTTQAGASKPDASTPNTNAEAKPTPGTQGQQTDQNNQAGAGTTVTPAPENNTQAGQGATGTPAQGTEAKPGNDQNAGTGQQTGTPAQGTETKPGNDQQGQGATGTGTPENTKPGENGAGTTVTPTPGENAGQTKPNGQENQEKPGAPETDQNAGTGQQTGTPDQNNAGDTTVKPPTAPDQGTEAKPDTQTKPDATTPDQNGTGAPGQDAGTKPGTTPDQTPGNTEQQGQGGTQTGTTTPQPGTTPDQNNQAGAGTTVTPAPENNTQPGQGTETKPGTDQQGQGAPDNTKPGENGTDNTVTPTPGENAGQTKPDGQEKPGTPGTDQNAGTGQQTGKPDENNAGDTTVKPPTNPDQGTEAKPDTQTKPGTTTPDQHDQLGAGVKPGTGTDQNTQVKPDDEHKPDTTKPGTGQQEGPTPDKNNGGDTTVKSPTKPDTQTKPSTTTTPDKNDTDDQDVKHHVTTVGDDKTTTTNIKKEKTELPDTGVSSEAAYTTTVFGTISLASALLLFRRQRKSSK

SEQ ID NO: 42097 - protein, 2040 aa, Staphylococcus epidermidis M23864:W1
MNNRDKLQKFSIRKYAIGTFSTVIATLVFVGFNPGQAHANEVSQNQKVIEQQEDSQIDEDNSNSKAHQLYSQVDNNQSRSSENNQPNALDKTTLTNNDENQNAIQSLESEQASTNSDENNINNQSLLSQEDLRINKDVINAKKQEEEEKENQDSSKKDNHKMIKQQLAEKRANKDDKNKDSVKKKAKNRQAQSPIDRNSLQALLDSSYHEYKMIDRDKANATEFNKVKATFDKVNELLGKEDNATSDELTLVYQELVQAIELARTLPQRSIDSNTLKRSTRGVNSDRAARGSVSYQNAYTEYYVSSDDDGSGYPPGTFLHASNKGAPYYLPTTPYNLLHASDVRNIAYITTKRLKNGYQWDVLFNLGHSNHENMIYWFAIPRDQTPAGPVTLTIINKDGRATSYDGSGSGSGKPLPKFWETAGGINPSVANYFRHGAAHGYQFYNTPYYQLNKFWDFARGSDEFAPNSYFNRNGASSTAKYYGDENYAFLNGDRPEQGQGLDSIYCFIGKGDVSYRISFKTSGLPTERLYYAAGGRALEFNQLYNYNQLYVEPMKVYQERIKSFVEVKNRTMHLGNTEYTYDSTLGKYANRAILDSDGDHTTDYADDPLSYVKNISDTIMGFMPPNAQYDSYRVFGVNDLNPVEIESLFAQDKLEEAARTGKPIKLMIGFNARDSSSNPETLVPVKLYVKPQLQQKISYWHNNEGTSIDTYTESRKVGHPVYQVMAGDMHNNSVEQQEIRIKLTSNEPIKDNDWLIYGYPHTLRLEKSTGRNNNAKEKNFSLVGTLEPGDYFITVKLGDKEEQFEVRAKPYPPTLVTTALQLKGKAGQKPDIVVTNVPPQTNAKVLLVVGGVNGRTDAFSDPYTKPEGYTVIARADATSHGTVTITSKDYLQGLPRSGEIKAITYFDDNVQSNFSNAITLITDETPPTIGEPVGLKDKYYRDNQVHFTIPVSDNQDGSGVNQVTIEGLPSGWTHSFVKAQNGQSGTLTVSGTISHAQALNSTIRLRLSASDMDNNVTKGDQIKTININVSSLAVDFPPLPLTNGNRVVVVNPTIISNDEKAIAKDRLARQNASRNNVLAVANTFQPQDNGNVLVNYKDDSQATMNEGNVYTYEPIRKNQFSESGITDKKIATIYVAKGSSFNIGKDMRNYFSLSNGQDIPNVPFTVMTPADPLPTPEQVSQFGDESHQYRVMAFNAYNKSIENLYIRIKAIDIVAPTGNHRVFRVNPIKLSDEEVQAVKQAFVDANPKLHLQTADIDVSNPTNGTGVSTVTVSVHKDQYTKTFTSSANDMNFLRWPNIREDYSITWSSDKLPNRNTDGGFSWSPDHKSIIYRYDATKGIAINTNQVLNLFTATTTVPGLRNNITGNEKILAEEGGTPSYKPNGYSSQINSDDRQRSFTKDGQLIQVLDLVQTGTGFGNAVVNHSNIVYNQSNSQVVNGEVPAANGAAAFQLEKVIKSNYVSEGIMGVVYKTHLFLTPYGAKQYIERTGSTMDTTTNVYDVYFVPSDNVKPTITFGDYSHNEVYSGETFKNTISVSDNYGVQSVSIPNDSGIRVSISNNNTQVSGTAPNVTSVTNKSVKVTAIDKSNNQIIEQFNVLLKPLKDKYRLTTSSTNQHPVRLNNIQNGATLSPAERQSVIDSVSVTNIAPRRSYITEPANEVQSKEVSNVIRPRNDATVTVTVTYKDGTINQISVPVKHVLPEVVSVPRYTVQGHNFPQDNGAAPRDFFRLQNGNTFTARVNWVGNNAPNINSNQIGVDIPLSAEIWFDGETTPIVKQTSYKIVKSEPKKVFETTINGQFVNSNDNPGNAGSYIKSINNSWPNGMYFDWAQGSSAPTSNTPGAFVRTATAIYPNGEREDVKILFKVQPSKPQIDANSVIAKGGLSNQQVIVRNVQNNVDVKLYQANGSVIPNTTSVIANGTATITVQGTLPTDNIYAKSSITTNNLTYAKRTNNDVSDTTENVTVTSENSDQVNVTVAMEAKNGGIKLVKGIDFNFNNFNNFISNAPANSRFAWAQSPDTWKCISDNRIKQSMLHCLITKEQEL

SEQ ID NO: 42098 - protein, 219 aa, Staphylococcus epidermidis M23864:W2; identical to SEQ ID NO: 39379

SEQ ID NO: 42099 - protein, 3692 aa, Staphylococcus epidermidis M23864:W2
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNNGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKIILEQKGNEKKSAIAQTPDATTEEKQEAVSAVSQAVTNGITHINQANSNDDVDQELSNAEQIITQTNVNVQKKPQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQSIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42100 - protein, 291 aa, Staphylococcus epidermidis M23864:W2; identical to SEQ ID NO: 39372

SEQ ID NO: 42101 - protein, 756 aa, Staphylococcus epidermidis M23864:W2
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGESHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAATGTPNTNGEQTGQPNATVTPGQGNEEINGASKPGEVSPKPEENNPTATEPGTTAPGNTNQDTQVKPNTDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 42102 - protein, 235 aa, Staphylococcus epidermidis M23864:W2; identical to SEQ ID NO: 41955

SEQ ID NO: 42103 - protein, 691 aa, Staphylococcus epidermidis M23864:W2
MLIVKTRQNKYSIRKFSVGASSILIAALLFMGGGSAQAAEQQQDKGTVENSTTQSIGDGNEKLSEQQSTQNKNVNEKSNVNSITENESLHNETPKNEDWIQQQKDSQNDNKSESVVEQNKENEAFVQNHSEEKPQQEQVELEKHASENNQTLHSKAAQSNEDVKTKPSQLDNTAAKQEDSQKENLSKQDTQSSKTTDLLRATAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 42104 - protein, 728 aa, Staphylococcus epidermidis M23864:W2; identical to SEQ ID NO: 39721

SEQ ID NO: 42105 - protein, 2491 aa, Staphylococcus epidermidis M23864:W2
MKNKQGFLPNLLNKYGIRKLSAGTASLLIGATLVFGINGQVKAAETDNIVSQNGDNKTNDSESSDKELVKSKDDKTSSTSTDTNLESEFDQNNKPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLLNDANHQTTDEVNHSDSDNMTNSTPNDTENELDTTQLTSHDESPSPQSDNFTGFTNLMATPLNLRNDNPRINLLAATEDTKPKTYIKPNNSEYSYLLNDLGYDATTVKENSDLRHAGISQSQDNTGSVIKLNLTKWLSLQSDFVNGGKVNLSFAQSDFYTQIESITLRGVKMDTTNNGQNWSAPINGSTVNSGLIGSVTNHEILITLKNSQTLSSLGYSNNKPVYLTHTWTTNDGAIAEESIQVASITPTLDSKAPNTTQESGFTAGRVINKIKYDSSQKSIKSVHTFKPNENFLQTDYRAVLYIKEQVNKELIPYIDPNSVKLYVSDPDGNPISQDRYVNGSIDNDGLFDSSKINEISIKNNNTSGQLNNARTSLDRNVFFGPLGQSRSYTISYKLKDGYTLESIASKVSARETFDSWMEVDYLDSYDSGTPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNVTETIFTIDVEDTTKPTVESIAGQTQEVNTEIEPIKIEAKDNSGQTVTNKVDGLPDGVTFDEATNTISGTPSEVGSYTVTVTTMDESGNATETTFTIDVEDTTKPTVESVADQTQEVNTEITPITIESEDNSDQAVTNKVDGLPDGVTFDEATNTISGTPSEVGSYTVTVTTTDESGNATETTFTIDVEDTTKPTVKSVSDQTQEVNTEITPIKIEATDNSGQTVTNKVDGLPDGITFDEATNTISGTPSEVGSYDITVTTTDESGNATETTFTINVEDTTKPTVEDIADQTQEVNTEIEPIKIEATDNGGQAVTNKVDGLPDGVTFDEATNTISGTPSEVGSYDIIVTTTDENGNSETTTFTIDVEDTTKPTVEDIADQTQEINTEIEPIKIEARDNSGQAVTNKVDGLPDGVTFDEATNTISGTPSEVGSYDITVTTTDESGNATETTFTIDVEDTTKPTVEDITDQTQEVNTEITPIKIEARDNSGQTVTNKVDGLPDGVTFDEATNTISGTPSEVGSYTVTVTTTDESSNATETTFTIDVEDTTKPTVEDIADQTQEVNTEITPIKIEATDNSGQAVTNKVDGLPDGVTFDEATNTISGTPSEVGSYDITVTTTDENGNSETTTFTIDVEDTTKPTVEDITDQTQEINTEMTPIKIEATDNSGQAVTNKVEGLPDGVTFDEATNTISGTPSEVGSYDITVTTTDENGNSETTTFTIDVEDTTKPTVESVADQTQEINTKIEPIKIEARDNSGQAVTNKVDGLPDGVTFDEATNTISGTPSEVGSYTVTVTTTDESGNATETTFTIDVEDTTKPTVEDIANQTQEVNTEIEPIKIEATDNSGQAVTNKVDGLPDGVTFDEATNTISGTPSEVGSYDITVTTTDKNGNSETTTFTIDVEDTTKPTVESVADQTQEVNTEITPITIESEDNSGQTVTNKVDGLPDGVTFDEATNTISGTPSEVGSYDITVTTTDENGNSETTTFTIDVEDTTKPTVESVADQTQEVNTEINPIKIEATDNSGQAVTNKVEGLPAGITFDEATNTISGTPSEVGSYTVTVTTTDENGNATETTFTIDVEDTTKPTVEDITDQTQEINTEINPIKIETTDNSGQTVTNKVEGLPDGVTFDEATNTISGTPSEVGSYTVTVTTTDENGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPKINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42106 - protein, 75 aa, Staphylococcus epidermidis M23864:W2
SGKPVEPGKPVEPGTPAQSGAPEQPNRSMHSTDNKNQLPDTGENRQANEGTLVGSLLAIVGSLFIFGRRKKGNEK

SEQ ID NO: 42107 - protein, 210 aa, Staphylococcus epidermidis M23864:W2
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGGNAEAPQSEPTKAEEGGNAEAAQSEPTKAEEGGNAEAAQSEPTKTEEGSNVKAAQSEPTKAEEGSNAEAPQSEPTKTEEGSNAKAAQSEPTKAEEGGNAEAAQSEPTKTEEG

SEQ ID NO: 42108 - protein, 334 aa, Staphylococcus epidermidis M23864:W2
MKRGVTILNWQRKCILTTLLVLSSLFLVFSTITYASERDSKDSLKITTHNVYFLPTAIYPNWGQSQRADLISKADYIQNQDVVILNELFDKKASNRLLTRLHSQYPYQTPIVGKGTEGWQNTSGTYRKIKKVSGDVGIVSKWPIVQQEQHIYKKGCGADMAGNKGFAYIKINKNGKYHHIIGTHLQAEDPTCFKGKDKDIRQSQMNEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42109 - protein, 209 aa, Staphylococcus epidermidis M23864:W2
DSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGALFAGLGALLLGRRRKKDNKEK

SEQ ID NO: 42110 - protein, 205 aa, Staphylococcus epidermidis M23864:W2; identical to SEQ ID NO: 39382

SEQ ID NO: 42111 - protein, 319 aa, Staphylococcus epidermidis M23864:W2
MKDNKPNNSKLIQTYLSKKTLRYGTASALTLALYLFNSNVTVYADENTANQNQGTSPKTSQTAPTNNTENTDATAITTDQNNNDEEEYDASYELPILYVTVWLDDQGNIIKDAVEDAKTPASERQPVKIPGYQHYRTSVSDGITKFIYRKISTAQSPIVENNQQDNNTNKVVETTNQNKDEVNGKEQNQANTSVTNTQITKNEKDEDTKTLKKDKDEKESKDTKTPKKDKEKKDIKTPKKDREEKKPVIPKSGKDEKDTKITKKDKEDEITTTSKKDNNNDVQDKLPETGKTNDIQNPALIMLLAGLGLLGLFRNKIRE

SEQ ID NO: 42112 - protein, 1048 aa, Staphylococcus epidermidis M23864:W2
MINKKNNLLTKKKPIANKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDNDSDLGNSSDKSTKDKLPDTGANEDYGSKGTLLGTLFAGLGALLLGKRRKNRKNKN

SEQ ID NO: 42113 - protein, 434 aa, Staphylococcus epidermidis M23864:W2
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEQGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 42114 - protein, 25 aa, Staphylococcus epidermidis NIH04003
MAADIISTIGDLVKWIIDTVNKFKK

SEQ ID NO: 42115 - protein, 205 aa, Staphylococcus epidermidis NIH04003; identical to SEQ ID NO: 39382

SEQ ID NO: 42116 - protein, 728 aa, Staphylococcus epidermidis NIH04003; identical to SEQ ID NO: 39721

SEQ ID NO: 42117 - protein, 688 aa, Staphylococcus epidermidis NIH04003; identical to SEQ ID NO: 41949

SEQ ID NO: 42118 - protein, 681 aa, Staphylococcus epidermidis NIH04003
MTNNNRIKRFSIRKYAVGVVSIITGVTIFIGGQQAQAAETSVQHADAHPEDSQTTQQLKNDKVEETLKASKQGNADSQQVQTIDQSKTNQNNQHSVTESAQLKSDETANQPKKEEGSSVKQDVQPSKNVNQQDVATQSNERENNDIKGEGQTSKTSNQHIQSSNSHNQSTGTKDSYSEEIDQPLVKLQKPSNDSTYQTQSKTKQDSSKQLPQEKTTKRQIQTTENEQTTKADSKKANDTQNVEKHTQEPKNDTSTSQKNHHQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHGWDHLDLVGMDAFDLTHTGRELGQFYLGIMDNIMRIEEADGITNK

SEQ ID NO: 42119 - protein, 1054 aa, Staphylococcus epidermidis NIH04003
MINKKNNLLTKKKPIANKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDNDSDLGNSSDKSTKDKLPDTGANEDYGSKGTLLGTLFAGLGALLLGKRRKNRKNKN

SEQ ID NO: 42120 - protein, 185 aa, Staphylococcus epidermidis NIH04003
DSESHSDSESDSDSESTSESDSESHSDSESHSDSESTSESDSESHSDSESDSDSESTSESDSESHSDSESHSDSESTSESDSESHSDSESDSDSESTSESDSESHSDSESDSDSESTSESDSESHSDSESDSDSESTSESGSESHSNSELPDTGEEDNHQGLIGGVLAAFGGLTLLGRRRKKEEK

SEQ ID NO: 42121 - protein, 511 aa, Staphylococcus epidermidis NIH04003
GPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGTPAEPGKPAEPGKPAEPGKPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42122 - protein, 235 aa, Staphylococcus epidermidis NIH04003; identical to SEQ ID NO: 41955

SEQ ID NO: 42123 - protein, 827 aa, Staphylococcus epidermidis NIH04003
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGESHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAATGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQSGATVKPSTTPNQDAEVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 42124 - protein, 219 aa, Staphylococcus epidermidis NIH04003; identical to SEQ ID NO: 39379

SEQ ID NO: 42125 - protein, 1545 aa, Staphylococcus epidermidis NIH04003
MKKRRQGPINKRVDFLSNKVNKYSIRKFTVGTASILVGATLMFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEYTTTKLKTPSISTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNLGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSGQDITVDSNGITTTGVINGADNLTIDSGFYKTPKYSVGDYVWKDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDADSDSDSDSDSDADSDSDADSDSDSDSDSDSDSDSDSDSDSDSDSDSDSDSDSDSDSDSDSDSDSDSDSDSDSDADSDSDSDSDSDADSDSDADSDSDSDSDSDADSDSDSDSDSDSDSDSDADSDSDSDSDSDADSDSDSDSDSDSDSDSDADSDSDSDSDSDSDSDSDADSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGALFAGLGALLLGRRRKKDNKEK

SEQ ID NO: 42126 - protein, 319 aa, Staphylococcus epidermidis NIH04003; identical to SEQ ID NO: 42111

SEQ ID NO: 42127 - protein, 327 aa, Staphylococcus epidermidis NIH04003
MNWQRKCILTTLLVLSSLFLVFSTITYASERDSKDSLKITTHNVYFLPTAIYPNWGQSQRADLISKADYIQNQDVVILNELFDKKASNRLLTRLHSQYPYQTPIVGKGTEGWQNTSGTYRKIKKVSGDVGIVSKWPIVQQEQHIYKKGCGADMAGNKGFAYIKINKNGKYHHIIGTHLQAEDPTCFKGKDKDIRQSQMNEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42128 - protein, 974 aa, Staphylococcus epidermidis NIH04003
MKKKLDFIPNKLNKFSIRRFTVGTASILVGSTLLFGIGNEAHAAEKNQELNTTANVADSDVGEAPSKEEAPSNEATNEALSKEEAPSNEATNEAPSKEEAPSNEATNEAPSKEEAPSNEATNEAPSKEETPSNEATNEAPSKEETPSNEATNEAPSKEEAPSNEATNEALSKEEAPSNEATNEAPSKEETPSNEATNEAPSKEKSTDNSTSNPEVDSEVLDNSKQGTDNDNSSNHSEDNIVTYAEPTALTNTRSVDSPSRVSSDNSQAQKQGKNVNDSIKVNSVDTDKEYVEPNNGQGFSTNVSFEVDGKVNKGDYFTVDMPEYADFNGIADYKAANNKIYPTINDGEQVVANGVYDTETKKLVYTFTDYVNKKDNIKGQFEIPQFIDRKNAKTSGDYDLNYNIADKTVSKPMKIVYNNYDEGHVVANTSSLITKADLFNVGSHDYTQYIYVNPKSEDSYNTRLTIQGYQEDLNNSSTLLNPKDSNIEILDAKSSDNITPSFYVNDSDFENVTNQYKIDQIGDKKAQIDFGHIDHPYIVKVTSKIDPNSSKDLRTRVIMENENAEGTKDFYVHDNTVERLGANGVATGNEKLYNLGDYVWEDTNKNGIQDEDEHGIEGVEVSLTRPNGTVETTTTNSEGKYEFNDLQNGDYVINFKTPEGYTATKAYEGNNAEVDSNGLSTVGTIKDADNWTLDSGFYKTPSKYSLGDYVWYDSNKDGYQDNDEKGIKGVKVTLKDSEGNTLKTTETDENGKYRFDDLDSGDYTVHFDKPEGLTQTSVNSGNDDAKDADGEDVHVTITDHDDFTIDNGYFEDSESDSSSESESDSESHSDSESHSDSESTSESDSESHSDSESTSESDSESHSDSESDSDSESTSESDSESHSDSESDSDSESTSESDSESHSDSESHSDSESTSESDSESHSDSESDSDSESTSESDSESHSDSESHSDSESTSESDSESHSDSESDSDSEST

SEQ ID NO: 42129 - protein, 1154 aa, Staphylococcus epidermidis NIH04003
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGGNAEAPQSEPTKAEEGGNAEAAQSEPTKAEEGSNVKAAQSEPTKAEEGSNAEAPQSEPTKTEEGSNAKAAQSEPTKAEEGGNAEAAQSEPTKTEEGSNAEAPQSEPTKSEEGGNAEAPQSEPTKTEEGGNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFNPDLKPGKERVKQKGEPGTKTITTPTTKNPLTGEKVGEGEPTEKVTKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKVTKQPVDEIVHYGGEEIKPGHKDEFDPNAPKGSQEDVPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKPGHKDEFDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKIT

SEQ ID NO: 42130 - protein, 2491 aa, Staphylococcus epidermidis NIH04003
MKNKQGFLPNLLNKYGIRKLSAGTASLLIGATLVFGINGQVKAAETDNIVSQNGDNKTNDSESSDKELVKSKDDKTSSTSTDTNLESEFDQNNKPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLLNDANHQTTDEVNHSDSDNMTNSTPNDTENELDTTQLTSHDESPSPQSDNFTGFTNLMATPLNLRNDNPRINLLAATEDTKPKTYIKPNNSEYSYLLNDLGYDATTVKENSDLRHAGISQSQDNTGSVIKLNLTKWLSLQSDFVNGGKVNLSFAQSDFYTQIESITLRGVKMDTTNNGQNWSAPINGSTVNSGLIGSVTNHEILITLKNSQTLSSLGYSNNKPVYLTHTWTTNDGAIAEESIQVASITPTLDSKAPNTTQESGFTAGRVINKIKYDSSQKSIKSVHTFKPNENFLQTDYRAVLYIKEQVNKELIPYIDPNSVKLYVSDPDGNPISQDRYVNGSIDNDGLFDSSKINEISIKNNNTSGQLNNARTSLDRNVFFGPLGQSRSYTISYKLKDGYTLESIASKVSARETFDSWMEVDYLDSYDSGTPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNVTETIFTIDVEDTTKPTVESIAGQTQEVNTEIEPIKIEAKDNSGQTVTNKVDGLPDGVTFDEATNTISGTPSEVGSYTVTVTTMDESGNATETTFTIDVEDTTKPTVESVADQTQEVNTEITPITIESEDNSDQAVTNKVDGLPDGVTFDEATNTISGTPSEVGSYTVTVTTTDESGNATETTFTIDVEDTTKPTVKSVSDQTQEVNTEITPIKIEATDNSGQTVTNKVDGLPDGITFDEATNTISGTPSEVGSYDITVTTTDESGNATETTFTINVEDTTKPTVEDIADQTQEVNTEIEPIKIEATDNGGQAVTNKVDGLPDGVTFDEATNTISGTPSEVGSYDIIVTTTDENGNSETTTFTIDVEDTTKPTVEDIADQTQEINTEIEPIKIEARDNSGQAVTNKVDGLPDGVTFDEATNTISGTPSEVGSYDITVTTTDESGNATETTFTIDVEDTTKPTVEDITDQTQEVNTEITPIKIEARDNSGQTVTNKVDGLPDGVTFDEATNTISGTPSEVGSYTVTVTTTDESSNATETTFTIDVEDTTKPTVEDIADQTQEVNTEITPIKIEATDNSGQAVTNKVDGLPDGVTFDEATNTISGTPSEVGSYDITVTTTDENGNSETTTFTIDVEDTTKPTVEDITDQTQEINTEMTPIKIEATDNSGQAVTNKVEGLPDGVTFDEATNTISGTPSEVGSYDITVTTTDENGNSETTTFTIDVEDTTKPTVESVADQTQEINTKIEPIKIEARDNSGQAVTNKVDGLPDGVTFDEATNTISGTPSEVGSYTVTVTTTDESGNATETTFTIDVEDTTKPTVEDIANQTQEVNTEIEPIKIEATDNSGQAVTNKVDGLPDGVTFDEATNTISGTPSEVGSYDITVTTTDKNGNSETTTFTIDVEDTTKPTVESVADQTQEVNTEITPITIESEDNSGQTVTNKVDGLPDGVTFDEATNTISGTPSKVGSYDITVTTTDENGNSETTTFTIDVEDTTKPTVESVADQTQEVNTEINPIKIEATDNSGQAVTNKVEGLPAGITFDEATNTISGTPSEVGSYTVTVTTTDENGNATETTFTIDVEDTTKPTVEDITDQTQEINTEINPIKIETTDNSGQTVTNKVEGLPDGVTFDEATNTISGTPSEVGSYTVTVTTTDENGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPTINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42131 - protein, 3692 aa, Staphylococcus epidermidis NIH04003; identical to SEQ ID NO: 42099

SEQ ID NO: 42132 - protein, 291 aa, Staphylococcus epidermidis NIH04003; identical to SEQ ID NO: 39372

SEQ ID NO: 42133 - protein, 434 aa, Staphylococcus epidermidis NIH04003; identical to SEQ ID NO: 39380

SEQ ID NO: 42134 - protein, 291 aa, Staphylococcus epidermidis NIH04008
MKKIDSWLTKHGLKNRLTLVVIVIFIIFLILLFMFVNLSDEDTGQITITENAELRTGPNAAYPFIYKIEKGKSFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 42135 - protein, 3692 aa, Staphylococcus epidermidis NIH04008
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQSIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42136 - protein, 688 aa, Staphylococcus epidermidis NIH04008
MKTRQNKYSIRKFSVGASSILIAALLFMGGGSAQAAEQQQGKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTAQQEDSQKENLSKQDTQSSKTTDLLRATGQNQSKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42137 - protein, 434 aa, Staphylococcus epidermidis NIH04008; identical to SEQ ID NO: 39380

SEQ ID NO: 42138 - protein, 327 aa, Staphylococcus epidermidis NIH04008
MNWQRKCILTTLLVLSSLFLVFSTITYASERDSKDSLKITTHNVYFLPTAIYPNWGQSQRADLISKADYIQNQDVVILNELFDKKASNRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMNEIKQFIKDKNIPKNEPVYIGGDLNVIKDSDEYQQMANNLNVLLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42139 - protein, 205 aa, Staphylococcus epidermidis NIH04008; identical to SEQ ID NO: 39382

SEQ ID NO: 42140 - protein, 1390 aa, Staphylococcus epidermidis NIH04008
MKKRRQGPINKRVDFLSNKVNKYSIRKFTVGTASILVGATLMFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEYTTTKLKTPSISTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISNVKVTLKNKNGDTIGTTTTDSNGKYEFTGLENGDYTIEFETPEGYTPTKQNSGSDEGKDSNGTKTTVTVKDADNKTIDSGFYKPIYNLGDYVWEDTNKDGIQDDSEKGISGVKVTLKDKNGNAIGTTTTDASGHYQFKGLENGSYTVEFETPSGYTPTKANSGQDITVDSNGITTTGIINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSNSDSDSDSDSDSDSDSDSDSDSDSDSDSDADSDSTQTVTQTQIVIRMQTATRIQIVIRMQTATRIQIVIRMQTATRILTVIRTQTVTPIQIVIRTQTVTRTQIVTPIQTVIRIPIAIRIPIVTRIQTVIRTQTATPIQIVIPTQTAIRIPIVTRIQTVIRTQTAIPIPIVTRIQTVIRTQTAIPIQTVTRTQIVTPIQTATRILIKMQKINYLIQEQMKIMILKAHYLELYLQV

SEQ ID NO: 42141 - protein, 201 aa, Staphylococcus epidermidis NIH04008; identical to SEQ ID NO: 41983

SEQ ID NO: 42142 - protein, 343 aa, Staphylococcus epidermidis NIH04008; identical to SEQ ID NO: 39377

SEQ ID NO: 42143 - protein, 491 aa, Staphylococcus epidermidis NIH04008
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATG

SEQ ID NO: 42144 - protein, 219 aa, Staphylococcus epidermidis NIH04008; identical to SEQ ID NO: 39379

SEQ ID NO: 42145 - protein, 728 aa, Staphylococcus epidermidis NIH04008; identical to SEQ ID NO: 39721

SEQ ID NO: 42146 - protein, 346 aa, Staphylococcus epidermidis NIH04008
PDTGEVVTPPVDDVTKYGPVDGDSITSTEEIPFDKNDEFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42147 - protein, 147 aa, Staphylococcus epidermidis NIH04008
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGGNAEAPQSEPTKAEEGGNAEAAQSEPTKAEEGGNAEAPQSEPTKAEEGG

SEQ ID NO: 42148 - protein, 25 aa, Staphylococcus epidermidis NIH04008
MAADIISTIGDLVKWIIDTVNKFKK

SEQ ID NO: 42149 - protein, 235 aa, Staphylococcus epidermidis NIH04008; identical to SEQ ID NO: 41955

SEQ ID NO: 42150 - protein, 190 aa, Staphylococcus epidermidis NIH04008; identical to SEQ ID NO: 30534

SEQ ID NO: 42151 - protein, 681 aa, Staphylococcus epidermidis NIH04008; identical to SEQ ID NO: 42118

SEQ ID NO: 42152 - protein, 190 aa, Staphylococcus epidermidis NIH05001; identical to SEQ ID NO: 30534

SEQ ID NO: 42153 - protein, 128 aa, Staphylococcus epidermidis NIH05001
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAE

SEQ ID NO: 42154 - protein, 933 aa, Staphylococcus epidermidis NIH05001
MINKKNNLLTKKKPITNKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 42155 - protein, 434 aa, Staphylococcus epidermidis NIH05001; identical to SEQ ID NO: 39380

SEQ ID NO: 42156 - protein, 327 aa, Staphylococcus epidermidis NIH05001
MNWQRKCILTTLLVLSSLFLVFSTITYASERDSKDSLKITTHNVYFLPTAIYPNWGQSQRADLISKADYIQNQDVVILNELFDKKASNRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMNEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42157 - protein, 728 aa, Staphylococcus epidermidis NIH05001; identical to SEQ ID NO: 39721

SEQ ID NO: 42158 - protein, 291 aa, Staphylococcus epidermidis NIH05001; identical to SEQ ID NO: 39372

SEQ ID NO: 42159 - protein, 1451 aa, Staphylococcus epidermidis NIH05001
MKKRRQGPINKRVDFLSNKVNKYSIRKFTVGTASILVGATLMFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEYTTTKLKTPSISTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTISNEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVSYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNVIGTTTTDASGHYQFKGLENGSYTVEFETPSGYTPTKANSGQDITVDSNGITTTGIINGADNLTIDSGFYKTPKYSVGDYVWKDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDSDSDSDSDSDSDSDSDSDSDSDSDSDSDSDSDSDADSDSDADSDSDSDSDSDSDSDSDSDSDSDSDSDSDADSDSDSDSDSDSDSDSDSDSDSDSDSDSDADSDSDSDSDSDSDSDSDSDSDSDADSDSDSDSDSDADSDSDSDSDSDADSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 42160 - protein, 814 aa, Staphylococcus epidermidis NIH05001
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQDTQIKPTSNQGTTATTNEIGNQKSSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTEQNNQNAEQGNTGQEGSNSNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDQTNQSTQDDNDNQNTQQGNTKQNNQNAEQGNTGGTDKDAKVNTNDDETKTDVKNDTELPETGLSNEYDYTTTVFGSIALISSLLLLRRQRKESK

SEQ ID NO: 42161 - protein, 130 aa, Staphylococcus epidermidis NIH05001
EPGTPAEPGTPAEPGKPAEPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42162 - protein, 688 aa, Staphylococcus epidermidis NIH05001; identical to SEQ ID NO: 39381

SEQ ID NO: 42163 - protein, 235 aa, Staphylococcus epidermidis NIH05001; identical to SEQ ID NO: 41955

SEQ ID NO: 42164 - protein, 205 aa, Staphylococcus epidermidis NIH05001
MEEKFNNSQEERQFQQFQEYQKRQEEEKKKKRKKGWLFGCGGCLVLLILIIVGVTVCTGTFVNEVDKEINEEGKLDKDKDTKIKSIGETTEIDGVSFTLDNASYTEERNEFADVQADKVIKVDMTVKNNSKEEIPVGGDIKVYVDGKQAKSYPIDNQLIDSLSPNREISESEGFAINGNPKKIELEFQPLTSFSNKRYIYNIKPE

SEQ ID NO: 42165 - protein, 25 aa, Staphylococcus epidermidis NIH05001
MAADIISTIGDLVKWIIDTVNKFKK

SEQ ID NO: 42166 - protein, 304 aa, Staphylococcus epidermidis NIH05001
MKDIKPNNSKLIQTYLSKKTIRYGTASALTLALYLFNSNVTAYANENTANQNQETSPKTSQTAPISNKENTDSTAVTTDQNNNDEEEYDASYELPILYVTVWLDDQGNIIKDAVEDAKTPASERQPVKIPGYQHYRTSVSDGITKFIYRKISTAQSPIVENNQQDNNTNKVVETTNQNKDEVNEKEQNQANTSVTNTQINKNEKDEDTNTPQKDKDEKDTKTPKKDREEKKPVIPKSGKDEKDTKITKKDKEDKITTTSKKDNNNDVQDKLPETGKTNDIQNPALIMLLAGLGLLGLFRNKIRE

SEQ ID NO: 42167 - protein, 3692 aa, Staphylococcus epidermidis NIH05001
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKGDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKENALNDINQAQTNQNVDTALTSGIQNIQNTQVNVRKKQEAKTTINDIVQQHKQSIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVARINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42168 - protein, 219 aa, Staphylococcus epidermidis NIH05001; identical to SEQ ID NO: 39379

SEQ ID NO: 42169 - protein, 681 aa, Staphylococcus epidermidis NIH05001; identical to SEQ ID NO: 42118

SEQ ID NO: 42170 - protein, 235 aa, Staphylococcus epidermidis NIH05003; identical to SEQ ID NO: 41955

SEQ ID NO: 42171 - protein, 681 aa, Staphylococcus epidermidis NIH05003; identical to SEQ ID NO: 41996

SEQ ID NO: 42172 - protein, 3692 aa, Staphylococcus epidermidis NIH05003; identical to SEQ ID NO: 42099

SEQ ID NO: 42173 - protein, 25 aa, Staphylococcus epidermidis NIH05003
MAADIISTIGDLVKWIIDTVNKFKK

SEQ ID NO: 42174 - protein, 688 aa, Staphylococcus epidermidis NIH05003; identical to SEQ ID NO: 41929

SEQ ID NO: 42175 - protein, 728 aa, Staphylococcus epidermidis NIH05003; identical to SEQ ID NO: 41977

SEQ ID NO: 42176 - protein, 85 aa, Staphylococcus epidermidis NIH05003; identical to SEQ ID NO: 41995

SEQ ID NO: 42177 - protein, 327 aa, Staphylococcus epidermidis NIH05003; identical to SEQ ID NO: 42020

SEQ ID NO: 42178 - protein, 756 aa, Staphylococcus epidermidis NIH05003
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASIQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKHDTELPETGLSNEYDYTTTVFGSIALISSLLLLRRQRKESK

SEQ ID NO: 42179 - protein, 2402 aa, Staphylococcus epidermidis NIH05003
MKNKQGFLPNLLNKYGIRKLSAGTASLLIGATLVFGINGQVKAAETDNIVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLSNDANHQTTDEVNHSDSDNMTNSTPNDTENELDTTQLTSHDESPSPQSDNFTGFTNLMATPLNLRNDNPRINLLAATEDTKPKTYKKPNNSEYSYLLNDLGYDATTVKENSDLRHAGISQSQDNTGSVIKLNLTKWLSLQSDFVNGGKVNLSFAQSDFYTQIESITLNDVKMDTTNNGQNWSAPINGSTVRSGLIGSVTNHDIVITLKNSQTLSSLGYSNNKPVYLTHTWTTNDGAIAEESIQVASITPTLDSKAPNTIQKSDFTAGRMTNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSGQLSNARTSLDRNVFFGTLGQSRSYTISYKLKDGYTLESVASKVSARETFDSWMEVDYLDSYDSGAPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNVTETIFTIDVEDTTKPTVESIAGQTQEVNTEIEPIKIEAKDNSGQTVTNKVDGLPDGVTFDEATNTISGTPSEVGSYDVTVTTTDESGNSETTTFTIEVKDTTKPTVESVADQTQEVNTEIEPIKIEARDNSGQAVTNKVDGLPDGVTFDEATNTISGTPSEVGSYDITVTTTDESGNVTETTFTIEVEDTTKPTVENVADQTQEVNTEITPITIESEDNSGQTVTNKVDGLPDGVTFDETTNTISGTPSKVGSYDITVTTTDESGNATETTFTIEVEDTTKPTVENVAGQTQEINTEIEPIKIEATDNSGQAVTNKVEGLPAGVTFDEATNTISGTPSEVGSYTVTVTTMDESGNATETTFTIDVEDTTKPTVESVADQTQEVNTEITPITIESEDNSDQAVTNKVDGLPDGVTFDEATNTISGTPSEVGSYTVTVTTTDESGNATETTFTIDVEDTTKPTVKSVSDQTQEVNTEITPIKIEATDNSGQTVTNKVDGLPDGITFDEATNTISGTPSEVGSYDITVTTTDESGNATETTFTINVEDTTKPTVEDIADQTQEVNTEIEPIKIEATDNGGQAVTNKVDGLPDGVTFDEATNTISGTPSEVGSYDIIVTTTDENGNSETTTFTIDVEDTTKPTVESVVDQTQEVNTEITPIKIEATDNSGQAVANKVDGLPNGVTFDETTNTISGTPSEVGSYDIIVTTTDESGNVTETIFTIDVEDTTKPTVESIAGQTQEVNTEIEPIKIEATDNSGQAVTNKVDGLPNGVTFDEATNTISGTPSEVGSYTVTVTTTDESGNATETTFTIDVEDTTKPTVESVADQTQEVNTEITPITIESEDNSGQAVTNKVEGLPAGMTFDETTNTISGTPSEVGSYTVTVTTTDESGNETETTFTIDVEDTTKPTVESIANQTQEVNTEITPIKIEATDNSGQAVTNKVDGLPNGVTFDETTNTISGTPSEVGSYDIKVTTTDESGNATETTFTINVEDTTKPTVESVADQTQEINTEIEPIKIEARDNSGQAVTNKVDGLPDGVTFDEATNTISGTPSEVGSYDITVTTTDESGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPTINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42180 - protein, 219 aa, Staphylococcus epidermidis NIH05003; identical to SEQ ID NO: 39379

SEQ ID NO: 42181 - protein, 427 aa, Staphylococcus epidermidis NIH05003
PGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGKPAEPGKPAEPGTPAEPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42182 - protein, 819 aa, Staphylococcus epidermidis NIH05003
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAEEGGNAEAPQSEPTKAEEGGNAEAAQSEPTKTEEGSNVKAAQSEPTKAEEGSNAEAPQSEPTKTEEGSNAKAAQSEPTKAEEGGNAEAAQSEPTKTEEGSNAEAPQSEPTKAEEGGNAEAPQSEPTKTEEGGNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEPGTKTITTPTTKNPLTGEKVGEGEPTEKITKQPVDEITEYGGEEIKP

SEQ ID NO: 42183 - protein, 291 aa, Staphylococcus epidermidis NIH05003
MKKIDSWLTKHGLKNRLTLVVIVIFIIFLILLFMFVNLSDEDTGQITITENAELRTGPNVAYPVIYKIEKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQETLAQTLNSAIQKKALLTNRGSRQQNYQVLRQTDIPAVLLELGYISNPTDESMINDQLHRQVVEQAIVDGLKQYFSS

SEQ ID NO: 42184 - protein, 434 aa, Staphylococcus epidermidis NIH05003; identical to SEQ ID NO: 39380

SEQ ID NO: 42185 - protein, 931 aa, Staphylococcus epidermidis NIH05003
MIKKNNLLTKKKPIANKSNKYAIRKFTVGTASIVIGATLLFGLGHNEAKAEENTVQDVKDSNMDDELSDSNDQSSNEEKNDVINNSQSINTDDDNQIKKEETNSNDAIENRSKDITQSTTNVDENEATFLQKTPQDNTQLKEEVVKEPSSVESSNSSMDTARQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 42186 - protein, 3692 aa, Staphylococcus epidermidis NIH05005; identical to SEQ ID NO: 42167

SEQ ID NO: 42187 - protein, 205 aa, Staphylococcus epidermidis NIH05005; identical to SEQ ID NO: 42164

SEQ ID NO: 42188 - protein, 170 aa, Staphylococcus epidermidis NIH05005
SDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 42189 - protein, 291 aa, Staphylococcus epidermidis NIH05005; identical to SEQ ID NO: 39372

SEQ ID NO: 42190 - protein, 343 aa, Staphylococcus epidermidis NIH05005; identical to SEQ ID NO: 39377

SEQ ID NO: 42191 - protein, 688 aa, Staphylococcus epidermidis NIH05005; identical to SEQ ID NO: 39381

SEQ ID NO: 42192 - protein, 162 aa, Staphylococcus epidermidis NIH05005
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAEEGGNAEAPQSEPTKAEEGGNAEAPQSEPTKAEEG

SEQ ID NO: 42193 - protein, 190 aa, Staphylococcus epidermidis NIH05005; identical to SEQ ID NO: 30534

SEQ ID NO: 42194 - protein, 927 aa, Staphylococcus epidermidis NIH05005
MKKRRQGPINKRVDFLSNKVNKYSIRKFTVGTASILVGATLMFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEYTTTKLKTPSISTDSSVNDKQDYTRSAVASLGVDSNETEVITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYIFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVSYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNSGSDEGKDSNGTKTTVTVKDADNKTIDSGFYKPTYNLGDYVWEDTNKDGIQDD

SEQ ID NO: 42195 - protein, 681 aa, Staphylococcus epidermidis NIH05005; identical to SEQ ID NO: 42118

SEQ ID NO: 42196 - protein, 327 aa, Staphylococcus epidermidis NIH05005; identical to SEQ ID NO: 42156

SEQ ID NO: 42197 - protein, 219 aa, Staphylococcus epidermidis NIH05005; identical to SEQ ID NO: 39379

SEQ ID NO: 42198 - protein, 25 aa, Staphylococcus epidermidis NIH05005
MAADIISTIGDLVKWIIDTVNKFKK

SEQ ID NO: 42199 - protein, 728 aa, Staphylococcus epidermidis NIH05005; identical to SEQ ID NO: 39721

SEQ ID NO: 42200 - protein, 125 aa, Staphylococcus epidermidis NIH05005
AEPGTPEEPGKPAEPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42201 - protein, 235 aa, Staphylococcus epidermidis NIH05005; identical to SEQ ID NO: 41955

SEQ ID NO: 42202 - protein, 814 aa, Staphylococcus epidermidis NIH05005
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQDTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTEQNNQNAEQGNTGQEGSNSNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDQTNQSTQDDNDNQNTQQGNTKQNNQNAEQGNTGGTDKDAKVNTNDDETKTDVKNDTELPETGLSNEYDYTTTVFGSIALISSLLLLRRQRKESK

SEQ ID NO: 42203 - protein, 861 aa, Staphylococcus epidermidis NIH05005
MINKKNNLLTKKKPITNKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDS

SEQ ID NO: 42204 - protein, 434 aa, Staphylococcus epidermidis NIH05005; identical to SEQ ID NO: 39380

SEQ ID NO: 42205 - protein, 688 aa, Staphylococcus epidermidis NIH051475; identical to SEQ ID NO: 41934

SEQ ID NO: 42206 - protein, 404 aa, Staphylococcus epidermidis NIH051475
MTRCRSPTYITIKQIKNERNQNMKNKRTLLKVITSTSVALLLSNLVMNSVVRAESNTSVSSYQTTIQKYIVNKNKLVKEIKINKGDKVQFLIKSKVLNNEPITSIKFSDDFENVFDIDKNVEVFIPKDETTVHDSLNFKEDFNNVTKQGVLKVNEDNESFEWIANNPNEFSGKTLYLVVKGTTKKDADYKKYISDKLTSISDVAKEQINSQELTSNSVDVIIKPDSNKNLVFIQNALAHQHISLDLLNDKKNKKATNINQIQQTSSKSKDIQNSNNKVSNSNNKITLNITSDEYEKEKKNSKQVQDSNKLVDKEQKNTQNTKDLKKENTKDSSKNNLDFKDKENIKKDNNIKKATDKPTKEKLLPNTGMTDNITYVMVGLIISLGSSILLLKVASKHYKNRKKC

SEQ ID NO: 42207 - protein, 824 aa, Staphylococcus epidermidis NIH051475; identical to SEQ ID NO: 41988

SEQ ID NO: 42208 - protein, 308 aa, Staphylococcus epidermidis NIH051475
SDSDSDSDSDSDSDSDSDSDSDSDSDSDSDSDSDSDSDSDSDNDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 42209 - protein, 681 aa, Staphylococcus epidermidis NIH051475
MKNNNRIKRFSIRKYAVGVVSIITGVTIFIGGQQAQAAEISVQHADAHPEDSQTTQQLKNDKVEETLKASKQGTADSQQVQRIDQSKTNQNNQHSVAESAQLKSDETANQPKVEEESSVKQDVQPSKNVNQQDVATQSNERENNDIKGESQTSKASNQHTQSSNSHNQSIGTKDSDSEELDQPLVKLQKPSNDSTYQTQSKAKQDSSKQLPQEKTTKHQIQTTENEQTTNVDSKKANDTQDARQHTQEPKNDTSTSQKNHHQVATKEQSNRSTTRETQKQSANSNQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42210 - protein, 728 aa, Staphylococcus epidermidis NIH051475
MKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQRITAKDGGVTRNNRGDKHLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGNRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGNISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42211 - protein, 434 aa, Staphylococcus epidermidis NIH051475; identical to SEQ ID NO: 39380

SEQ ID NO: 42212 - protein, 219 aa, Staphylococcus epidermidis NIH051475; identical to SEQ ID NO: 39379

SEQ ID NO: 42213 - protein, 235 aa, Staphylococcus epidermidis NIH051475; identical to SEQ ID NO: 41955

SEQ ID NO: 42214 - protein, 3692 aa, Staphylococcus epidermidis NIH051475; identical to SEQ ID NO: 42135

SEQ ID NO: 42215 - protein, 1005 aa, Staphylococcus epidermidis NIH051475
MINKKNNLLTKKKPIANKSNKYAIRKFTVGTASIVIGATLLFGLGHNEAKAEENTVQDVKDSNTDDELSDSNDQSSNEEKNDVINNSQSINTDDDNQINKKEETNSNDAIENRSKDITQSTTNVDENEATFLQKTPQDNTQLKEEVVKEPSSVESSNSSMDTAQQPSHTTINSEASIQTSDNEENSRVSDFANSKIKEINTESDKEENTIEQPNKVREDSTTSQPSSYRNIDEKISNQDELLNLPINEYENKARPLSTTSAQSPIKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPELDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADWEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDNDSDSDSDSDSDSDSDSDSDSDSDSDSDSDSDS

SEQ ID NO: 42216 - protein, 25 aa, Staphylococcus epidermidis NIH051475
MAADIISTIGDLVKWIIDTVNKFKK

SEQ ID NO: 42217 - protein, 327 aa, Staphylococcus epidermidis NIH051475; identical to SEQ ID NO: 42020

SEQ ID NO: 42218 - protein, 1712 aa, Staphylococcus epidermidis NIH051475
MFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSVSTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEIVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSGQDITVDSNGITTTGVINGADNLTIDSGFYKTPKYSVGDYVWKDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDADSDSDSDSDSDADSDSDSDSDSDSDSDSDADSDSDSDSDSDADSDSDSDSDSDSDSDSDSDSDSDSDSDSDSDSDSDSDADSDSDSDSDSDADSDSDADSDSDSDSDSDADSDSDSDSDSDADSDSDSDSDSDSDSDSDADSDSDSDSDSDSDSDSDSDSDSDSDSDSDADSDSDSDSDSDSDSDSDSDSDSDSDSDSDADSDSDSDSDSDSDSDSDSDSDSDSDSDSDADSDSDSDSDSDSDSDSDSDSDSDSDSDSDADSDADSDSDADSDSDSDSDSDSDSDSDADSDSDSDSDSDSDSDSDSDSDSDSDSDSDSDSDSDADSDSDSDSDSDSDSDSDADSDSDSDSDSDADSDSDSDSDSDADSDSDSDSDSDADSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDADSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 42219 - protein, 931 aa, Staphylococcus epidermidis NIH051475
MKKKLDFIPNKLNKFSIRRFTVGTASILVGSTLLFGIGNEAHAAEKNQELNTTANVADSDVGEAPSKEEAPSNEATNEALSKEEAPSNEATNEAPSKEEAPNNEATNEAPSKEEAPSNEATNEAPSKEEAPSNEATNEAPSKEETPSNEATNEAPSKEETPSNEATNEAPSKEEVPSNEATNEALSKEETPSNEATNEAPSKEKSTDNSTSNPEVDSEVLDNSKQGTDNDNSSNHSEDNIVTYAEPTALTNTRSVDSPSRVSSDNSQAQKQGKNVNDSIKVNSVDTDKEYVEPNNGQGFSTNVSFEVDGKVNKGDYFTVDMPEYADFNGIADYKAANNKIYPTINDGEQVVANGVYDTETKKLVYTFTDYVNKKDNIKGQFEIPQFIDRKNAKTSGDYDLNYNIADKTVSKPMKIVYNNYDEGHVVANTSSLITKADLFNVGSHDYTQYIYVNPKSEDSYNTRLTIQGYQEDLNNSSTLLNPKDSNIEILDAKSSDNITPSFYVNDSDFENVTNQYKIDQIGDKKAQIDFGHIDHPYIVKVTSKIDPNSSKDLRTRVIMENENAEGTKDFYVHDNTVERLGANGVARGDEKLYNLGDYVWEDTNKNGIQDEGEKGIEGVEVSLTRPNGTIETTKTNSDGKYEFKDLPNGNYVINFKTPEGYTATKAYQGVNSEVDSNGLSTVGVIQDGDNWTLDSGFYKTSSKYSLGDYVWYDSNKDGYQDENEKGIQGVKVTLKDSEGNVLKSTETDENGKYRFDELDSGDYTVHFDKPEGLTQTSTNSGNDDAKDADGEEVHVTITDHDDFTIDNGYFEDSESTSESDSDSESTSESDSDSESTSESDSDSESTSESDSDSESTSESDSDSESTSESDSDSESTSESDSDSESTSESDSDSESTSESDSDSESTSESDSDSESTSESDSDSESTSESDS

SEQ ID NO: 42220 - protein, 291 aa, Staphylococcus epidermidis NIH051475; identical to SEQ ID NO: 39372

SEQ ID NO: 42221 - protein, 204 aa, Staphylococcus epidermidis NIH051668; identical to SEQ ID NO: 31936

SEQ ID NO: 42222 - protein, 327 aa, Staphylococcus epidermidis NIH051668; identical to SEQ ID NO: 42156

SEQ ID NO: 42223 - protein, 168 aa, Staphylococcus epidermidis NIH051668
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGGNAEAPQSEPTKAEEGGNAEAAQSEPTKAEEGGNAEAPQSEPTKAEEGGNAEAAQSEPTKAEEGGNAEAA

SEQ ID NO: 42224 - protein, 728 aa, Staphylococcus epidermidis NIH051668; identical to SEQ ID NO: 39721

SEQ ID NO: 42225 - protein, 434 aa, Staphylococcus epidermidis NIH051668; identical to SEQ ID NO: 39380

SEQ ID NO: 42226 - protein, 25 aa, Staphylococcus epidermidis NIH051668
MAADIISTIGDLVKWIIDTVNKFKK

SEQ ID NO: 42227 - protein, 190 aa, Staphylococcus epidermidis NIH051668; identical to SEQ ID NO: 30534

SEQ ID NO: 42228 - protein, 235 aa, Staphylococcus epidermidis NIH051668; identical to SEQ ID NO: 41955

SEQ ID NO: 42229 - protein, 404 aa, Staphylococcus epidermidis NIH051668
MTRCRSPTYITIKQIKNERNQNMKNKRTLLKVITSTSVALLLSNLVMNSVVRAESNTSVSSYQTTIQKYIVNKNKLVKEIKINKGDKVQFLIKSKVLNNEPITSIKFSDDFENVFDIDKNVEVFIPKDETTVHDSLNFKEDFNNVTKQGVLKVNEDNESFEWIANNPNEFSGKTLYLVVKGTTKKDADYKKYISDKLTSISDVAKEQINSQELTSNSVDVIIKPDSNKNLVFIQNALAHQHISLDLLNDKKNKKATNINQIQQTSSKSKDIQNSNNKVSNSNNKITLNITSDEYEKEKKNSKQVQDSNKLVDKEQKNTQNTKDLKKENTKDSSKNNLDSKDKENIKKDNNIKKATDKPTKEKLLPNTGMTDNITYVMVGLIISLGSSILLLKVASKHYKNRKKC

SEQ ID NO: 42230 - protein, 681 aa, Staphylococcus epidermidis NIH051668; identical to SEQ ID NO: 42118

SEQ ID NO: 42231 - protein, 291 aa, Staphylococcus epidermidis NIH051668; identical to SEQ ID NO: 39372

SEQ ID NO: 42232 - protein, 3692 aa, Staphylococcus epidermidis NIH051668
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQSIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKSNEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42233 - protein, 219 aa, Staphylococcus epidermidis NIH051668; identical to SEQ ID NO: 39379

SEQ ID NO: 42234 - protein, 1592 aa, Staphylococcus epidermidis NIH051668
MFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEYTTTKLKTPSISTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSKNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISNVKVTLKNKNGDTIGTTTTDSNGKYEFTGLENGDYTIEFETPEGYTPTKQNSGSDEGKDSNGTKTTVTVKDADNKTIDSGFYKPIYNLGDYVWEDTNKDGIQDDSEKGISGVKVTLKDKNGNAIGTTTTDASGHYQFKGLENGSYTVEFETPSGYTPTKANSGQDITVDSNGITTTGIINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSNSDSDSDSDSDSDSDSDSDSDSDSDSDSDADSDSDADSDSDSDSDSDSDSDSDSDSDSDSDSDSDSDADSDSDADSDSDADSDSDADSDSDSDSDSDADSDSDSDSDSDADSDSDSDSDSDADSDSDSDSDSDADSDSDSDSDSDADSDSDSDSDSDSDSDSDSDSDSDSDSDSDSDSDSDSDSDSDSDADSDSDSDSDSDADSDSDADSDSDSYSDSDSDSDSDADSDSDSDSDSDSDSDSDADSDSDSDSDSDAESDSDSDSDSDSDSDSDSDSDSDSDSDSDSDSDSDADSDSDSDSDSDSDSDSDSDSDSDSDSDSDADSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 42235 - protein, 205 aa, Staphylococcus epidermidis NIH051668; identical to SEQ ID NO: 39382

SEQ ID NO: 42236 - protein, 611 aa, Staphylococcus epidermidis NIH051668
FDPNAPKGSQEDVPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKTGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGTPAQSGAPEQPNRSMHSTDNKNQLPDTGENRQANEGTLVGSLLAIVGSLFIFGRRKKGNEK

SEQ ID NO: 42237 - protein, 688 aa, Staphylococcus epidermidis NIH051668; identical to SEQ ID NO: 41929

SEQ ID NO: 42238 - protein, 815 aa, Staphylococcus epidermidis NIH051668; identical to SEQ ID NO: 39714

SEQ ID NO: 42239 - protein, 291 aa, Staphylococcus epidermidis NIH06004
MKKIDSWLTKHGLKNRLTLVVIVIFIIFLILLFMFVNLSDEDTGQITITENAELRTRPNAAYPVIYKIEKGKSFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 42240 - protein, 434 aa, Staphylococcus epidermidis NIH06004; identical to SEQ ID NO: 39380

SEQ ID NO: 42241 - protein, 327 aa, Staphylococcus epidermidis NIH06004; identical to SEQ ID NO: 42127

SEQ ID NO: 42242 - protein, 134 aa, Staphylococcus epidermidis NIH06004
SDSESTSESDSESHSDSESHSDSESTSESDSESHSDSESDSDSESTSESDSESHSDSESDSDSESTSESDSESHSDSESDSDSESTSESGSESHSNSELPDTGEEDNHQGLIGGVLAAFGGLTLLGRRRKKEEK

SEQ ID NO: 42243 - protein, 728 aa, Staphylococcus epidermidis NIH06004; identical to SEQ ID NO: 39721

SEQ ID NO: 42244 - protein, 2491 aa, Staphylococcus epidermidis NIH06004; identical to SEQ ID NO: 42130

SEQ ID NO: 42245 - protein, 25 aa, Staphylococcus epidermidis NIH06004
MAADIISTIGDLVKWIIDTVNKFKK

SEQ ID NO: 42246 - protein, 265 aa, Staphylococcus epidermidis NIH06004
DADSDSDSDSDSDADSDSDSDSDSDSDSDSDADSDSDSDSDSDSDSDSDADSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGALFAGLGALLLGRRRKKDNKEK

SEQ ID NO: 42247 - protein, 144 aa, Staphylococcus epidermidis NIH06004
MKKKLDFIPNKLNKFSIRRFTVGTASILVGSTLLFGIGNEAHAAEKNQELNTTANVADSDVGEAPSKEEAPSNEATNEALSKEEAPSNEATNEAPSKEEAPSNEATNEAPSKEEAPSNEATNEAPSKEETPSNEATNEAPSKEE

SEQ ID NO: 42248 - protein, 191 aa, Staphylococcus epidermidis NIH06004
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGGNAEAPQSEPTKAEEGGNAEAAQSEPTKAEEGGNAEAPQSEPTKAEEGGNAEAAQSEPTKAEEGGNAEAAQSEPTKTEEGSNVKAAQSEPTKA

SEQ ID NO: 42249 - protein, 688 aa, Staphylococcus epidermidis NIH06004; identical to SEQ ID NO: 41949

SEQ ID NO: 42250 - protein, 827 aa, Staphylococcus epidermidis NIH06004; identical to SEQ ID NO: 42123

SEQ ID NO: 42251 - protein, 205 aa, Staphylococcus epidermidis NIH06004; identical to SEQ ID NO: 39382

SEQ ID NO: 42252 - protein, 1349 aa, Staphylococcus epidermidis NIH06004
MKKRRQGPINKRVDFLSNKVNKYSIRKFTVGTASILVGATLMFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEYTTTKLKTPSISTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNLGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSGQDITVDSNGITTTGVINGADNLTIDSGFYKTPKYSVGDYVWKDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDADSDSDSDSDSDADSDSDADSDSDSDSDSDSDSDSDSDSDSDSDSDSDSDSDSDSDSDSDSDSDSDSDSDSDSDADSDSDSDSDSDADSDSDADSDSDSDSDSDADSDSDSDSDSDSDSDSDADSDSDSDSDSDADSDSDSDSDSDSDSDSDADSDSDSDSDSDSDSDSDADSDSDSDSDSDADSDSDSD

SEQ ID NO: 42253 - protein, 219 aa, Staphylococcus epidermidis NIH06004; identical to SEQ ID NO: 39379

SEQ ID NO: 42254 - protein, 319 aa, Staphylococcus epidermidis NIH06004; identical to SEQ ID NO: 42111

SEQ ID NO: 42255 - protein, 3692 aa, Staphylococcus epidermidis NIH06004; identical to SEQ ID NO: 42099

SEQ ID NO: 42256 - protein, 1076 aa, Staphylococcus epidermidis NIH06004
MINKKNNLLTKKKPIANKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDNDSDLGNSSDKSTKDKLPDTGANEDYGSKGTLLGTLFAGLGALLLGKRRKNRKNKN

SEQ ID NO: 42257 - protein, 681 aa, Staphylococcus epidermidis NIH06004; identical to SEQ ID NO: 42118

SEQ ID NO: 42258 - protein, 570 aa, Staphylococcus epidermidis NIH06004
QPVDEIVHYGGEEIKPGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGTPAEPGKPAEPGKPAEPGKPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42259 - protein, 235 aa, Staphylococcus epidermidis NIH06004; identical to SEQ ID NO: 41955

SEQ ID NO: 42260 - protein, 205 aa, Staphylococcus epidermidis NIH08001; identical to SEQ ID NO: 39382

SEQ ID NO: 42261 - protein, 25 aa, Staphylococcus epidermidis NIH08001
MAADIISTIGDLVKWIIDTVNKFKK

SEQ ID NO: 42262 - protein, 728 aa, Staphylococcus epidermidis NIH08001; identical to SEQ ID NO: 39721

SEQ ID NO: 42263 - protein, 2491 aa, Staphylococcus epidermidis NIH08001; identical to SEQ ID NO: 42130

SEQ ID NO: 42264 - protein, 327 aa, Staphylococcus epidermidis NIH08001; identical to SEQ ID NO: 42127

SEQ ID NO: 42265 - protein, 434 aa, Staphylococcus epidermidis NIH08001; identical to SEQ ID NO: 39380

SEQ ID NO: 42266 - protein, 219 aa, Staphylococcus epidermidis NIH08001; identical to SEQ ID NO: 39379

SEQ ID NO: 42267 - protein, 319 aa, Staphylococcus epidermidis NIH08001; identical to SEQ ID NO: 42111

SEQ ID NO: 42268 - protein, 436 aa, Staphylococcus epidermidis NIH08001
VHYGGEEIKPGHKDEFDPNAPKGSQEDVPGKPGVKNPDTGEVVTPPVDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAEPGTPAEPGKPAEPGKPAEPGKPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42269 - protein, 167 aa, Staphylococcus epidermidis NIH08001
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGGNAEAPQSEPTKAEEGGNAEAAQSEPTKAEEGGNAEAPQSEPTKAEEGGNAEAAQSEPRGRRGGNAEAA

SEQ ID NO: 42270 - protein, 827 aa, Staphylococcus epidermidis NIH08001; identical to SEQ ID NO: 42123

SEQ ID NO: 42271 - protein, 291 aa, Staphylococcus epidermidis NIH08001; identical to SEQ ID NO: 42239

SEQ ID NO: 42272 - protein, 235 aa, Staphylococcus epidermidis NIH08001; identical to SEQ ID NO: 41955

SEQ ID NO: 42273 - protein, 688 aa, Staphylococcus epidermidis NIH08001; identical to SEQ ID NO: 41949

SEQ ID NO: 42274 - protein, 1545 aa, Staphylococcus epidermidis NIH08001; identical to SEQ ID NO: 42125

SEQ ID NO: 42275 - protein, 681 aa, Staphylococcus epidermidis NIH08001; identical to SEQ ID NO: 42118

SEQ ID NO: 42276 - protein, 1076 aa, Staphylococcus epidermidis NIH08001; identical to SEQ ID NO: 42256

SEQ ID NO: 42277 - protein, 3692 aa, Staphylococcus epidermidis NIH08001; identical to SEQ ID NO: 42099

SEQ ID NO: 42278 - protein, 138 aa, Staphylococcus epidermidis NIHLM001
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEALNLSQRRQKKEAMTEAAQS

SEQ ID NO: 42279 - protein, 291 aa, Staphylococcus epidermidis NIHLM001; identical to SEQ ID NO: 41958

SEQ ID NO: 42280 - protein, 688 aa, Staphylococcus epidermidis NIHLM001; identical to SEQ ID NO: 41949

SEQ ID NO: 42281 - protein, 267 aa, Staphylococcus epidermidis NIHLM001
MVMIDLYITFYIHIFILFGYSNNYSYIEDIGNHRGYTAGIIGFTTGTDDMVHLVKHYNKINPNNDLKKYEGALKQLSKEGSESHKGLEGFDKAWKNASKNDRDNFVKAQNYVLKHDYMNKAVQAAKDDGLSQLGQYVYFDAIVKHGPGEFKQGGYKGKDPADWSFDELRERAIDKSGGKSPKNGVNEEDFLNAFLDGRFKSIQKENENNESNDNDVFDRLKTQQRFIKDKNFDLKLPLDFKMNGENFHLDQDAINHYNDQDLDFDNA

SEQ ID NO: 42282 - protein, 327 aa, Staphylococcus epidermidis NIHLM001
MNWQRKCILTTLLVLSSLFLVFSTITYASERDYKDSLKITTHNVYFLPTAIYPNWGQSQRADLISKADYIQNQDVVILNELFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42283 - protein, 205 aa, Staphylococcus epidermidis NIHLM001
MEEKFNNSQEERQFQQFQEYQKRQEEEKKKKRKKGWLFGCGGCLVLLILIIVGVTACTGTFVNEVDKEINEEGKLDKDKDTKIKSIGETTEIDGVSFTLDNASYTEERNEFADVQADKVIKVDMTVKNNSKEEIPVGGDVKVYVDGKQAKSYPIDNQLIDSLSPNREISGSEGFAINGNPKKIELEFQPLTSFSNKRYIYNIKPE

SEQ ID NO: 42284 - protein, 25 aa, Staphylococcus epidermidis NIHLM001
MAADIISTIGDLVKWIIDTVNKFKK

SEQ ID NO: 42285 - protein, 87 aa, Staphylococcus epidermidis NIHLM001
GYGQGYGQGSASESTETPKTITTSTTETTPDKKEVTHGEKTEHSANELPETGEENQENKGLLASIASILGLSGLATLFVNRKRKTNE

SEQ ID NO: 42286 - protein, 645 aa, Staphylococcus epidermidis NIHLM001
MSKLSKLKTYNFQITSNNKEKTSRIGVAIALNNRDKLQKFSIRKYAIGTFSTVIATLVFMGINTNHASADELNQNQKLIKQLNQTDDDDSNTHSQEIENNKQNSSGQTESLRSSTSQNQANARLSDQFKDTNETSQQLPTNVSDDSINQSHSEANMNNEPLKVDNSTMQAHSKIVSDSDGNASENEHHKLTENVLAESRASKNDKEKENLQEKDKSQQVQPPLDKNALQAFFDASYHNYRMIDRDRADATEYQKVKSTFDYVNDLLGNNQNIPSEQLVSAYQQLEKALELARTLPQRSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYGDENFALLNSEKPDQIRGLDTIYSFKGSGDVSYRISFKTQGAPTARLYYAAGARSGEYRQATNYNQLYVEPYKNYRNRVQSNVQVKNRTLHLKRTIRQYDPTLQRTTDVPILDSDGSGSIDSVYDPLSYVKNVTGTVLGNLSILSSL

SEQ ID NO: 42287 - protein, 681 aa, Staphylococcus epidermidis NIHLM001
MKNNNRIKRFSIRKYAVGVVSIITGVTIFIGGQQAQAAEISVQHADAHPEDSQTTQQLKNDKVEETLKASKQGTADSQQVQRIDQSKTNQNNQHSVAESAQLKSDETANQPKVEEESSVKQDVQPSKNVNQQDVATQSNERENNDIKGESQTLKASNQHTQSSNSHNQSIGTKDSDSEELDQPLVKLQKPSNDSTYQTQSKAKQDSSKQLPQEKTTKHQIQTTENEQTTNVDSKKANDTQDARQHTQEPKNDTSTSQKNHHQVATKEQSNRSTTRETQKQSANSNQNHQSTHQAQFKNQYPVVFVHGFLGFTGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQTFKKVDDHTPATDKGVWQVRPVQHDWDHLDLVGMDAFDLTHTGRELGQFYLGIMDNIMRIEEADGITNK

SEQ ID NO: 42288 - protein, 659 aa, Staphylococcus epidermidis NIHLM001
MKKSSKFSKDFPTRKNHYAIRKFTVGTASIIVGSFLFFGQTQAHAEQAEEFERVTTGTVDTGGQPARANQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTQTNGQDGDPTNQSTQDDNDNQNKQQGNTKQNNQNAEQGNTGDTDKDAKVNTDDDETKTDVKNDTELPETGLSNEYDYTTTVFGSIALISSLLLLRRQRKESK

SEQ ID NO: 42289 - protein, 324 aa, Staphylococcus epidermidis NIHLM001
MDDVTKYGPVDGDSITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGTPAEPGKPAESGKPVEPGKPVEPGKPVEPGTPAQSGAPEQPNRSMHSTDNKNQLPDTGENRQANEGTLVGSLLAIVGSLFIFGRRKKGNEK

SEQ ID NO: 42290 - protein, 235 aa, Staphylococcus epidermidis NIHLM001
MKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTLTTSYSAPSHNYSSHSSSVRLSNGNTAGSVGSYAAAQMAARTGVSASTWEHIIARESNGQLHARNASSAAGLFQTMPGWGSTGSVNDQINAAYKAYKAQGLSAWGM

SEQ ID NO: 42291 - protein, 207 aa, Staphylococcus epidermidis NIHLM001
DHHKGSKDDDTKKPDQSDKDDHHQGKDDGQDNHKKDKDHNDKDHHKCSKDDDTKKPDQSDKDDHHQGKDDGQDDSKSEPSKDTDNKGNHNTTSKDGKHNGKSPVAPITAATMTPAMTHAHGYGQGYGQGSASESTETPKTITTSTTETTPDKKEVTHGEKTEHSANELPETGEENQENKGLLASIASILGLSGLATLFVNRKRKTNE

SEQ ID NO: 42292 - protein, 411 aa, Staphylococcus epidermidis NIHLM001; identical to SEQ ID NO: 41922

SEQ ID NO: 42293 - protein, 219 aa, Staphylococcus epidermidis NIHLM001; identical to SEQ ID NO: 39379

SEQ ID NO: 42294 - protein, 434 aa, Staphylococcus epidermidis NIHLM001
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAAQIKTGSLSRTDRIAKYNQLLRIEDELYETAKFEGIKSFYNLDK

SEQ ID NO: 42295 - protein, 728 aa, Staphylococcus epidermidis NIHLM001
MKNKKNSYSIRKLSVGASSIIVASMLFIGGGSVHAAESNHLENQEQSEVSVSHSIEMQHKNQETQQPENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDIKNAQQENQNIDQEKSQEKIKVQQSNIEKAQKSSRIDGKLDNQYNKDATQSDEGTASENVSEQHITAKDGGVTRNNRGDERLNQEKPTTSSDKELKVDDIDKNLSTKESPENEKDDSRKGIKALTKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42296 - protein, 688 aa, Staphylococcus epidermidis NIHLM003; identical to SEQ ID NO: 39381

SEQ ID NO: 42297 - protein, 728 aa, Staphylococcus epidermidis NIHLM003
MKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQFNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKAITKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42298 - protein, 124 aa, Staphylococcus epidermidis NIHLM003
EPGKPAEPGKPAEPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42299 - protein, 25 aa, Staphylococcus epidermidis NIHLM003
MAADIISTIGDLVKWIIDTVNKFKK

SEQ ID NO: 42300 - protein, 509 aa, Staphylococcus epidermidis NIHLM003
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPSTTPNQDAEVKPNPDQNNTPTNGQDGNQTGQGTQVKPNNDQTATGTQGATGNQNAEQ

SEQ ID NO: 42301 - protein, 219 aa, Staphylococcus epidermidis NIHLM003; identical to SEQ ID NO: 39379

SEQ ID NO: 42302 - protein, 85 aa, Staphylococcus epidermidis NIHLM003; identical to SEQ ID NO: 41995

SEQ ID NO: 42303 - protein, 291 aa, Staphylococcus epidermidis NIHLM003; identical to SEQ ID NO: 41958

SEQ ID NO: 42304 - protein, 3692 aa, Staphylococcus epidermidis NIHLM003
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNNGNDTTSTTQNTDPNLSNTGPNGINTVITFDDLGIKTSTNRSRPEVKVVDSLNGFTMVNGGKVGLLNSVLERTSVFDSADPKNYQAIDNVVTLGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKIILEQKGNEKKSAIAQTPDATTEEKQEAVSAVSQAVTNGITHINQANSNDDVDQELSNAEQIITQTNVNVQKKPQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKSDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKTSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIVENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNNVVETTNQAIEDAPDTNQVNVEKNKGIGTIRDIQPLVVKKPTAKSKIESAVEKKKTEINQTQNATHDEVREGLNQLKQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDAQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRAHKQIDEAETFVSVETIVRNFKVEADKLNSIVRKKAKALKEIELEADHVKQMINTNLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42305 - protein, 235 aa, Staphylococcus epidermidis NIHLM003; identical to SEQ ID NO: 41955

SEQ ID NO: 42306 - protein, 1052 aa, Staphylococcus epidermidis NIHLM003
MINKKNNLLTKKKPIANKSNKYAIRKFTVGTVSIVIGATLLFGLGHNEAKAEENSVQDVKDSNTDDELSDSNDQSSDEEKNDVINNNQSINNDDNNQIIKKEETNNNDGIEKRSEDRTKSTTNVDENEATFLQKTPQDNTHLTEEEVKEPSSVESSNSSIDTAQQPSHTTINREESVQTSDNVEDSHVSDFANYKIKESNTESGKEENTLEQPNKVREDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKAYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDLGNSSDKSTKDKLPDTGANEDYDSKGTLLGTLFAGLGALLLGKRRKNKKNKN

SEQ ID NO: 42307 - protein, 173 aa, Staphylococcus epidermidis NIHLM003
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSEPTKAEEGGNAEAAQSEPTKTEEGSNVKAAQSEPT

SEQ ID NO: 42308 - protein, 681 aa, Staphylococcus epidermidis NIHLM003; identical to SEQ ID NO: 41996

SEQ ID NO: 42309 - protein, 327 aa, Staphylococcus epidermidis NIHLM003; identical to SEQ ID NO: 42282

SEQ ID NO: 42310 - protein, 434 aa, Staphylococcus epidermidis NIHLM003; identical to SEQ ID NO: 39380

SEQ ID NO: 42311 - protein, 329 aa, Staphylococcus epidermidis NIHLM008
MKNSKNFSTRKIALGTSSALLATLITVNGTGLAHASETQNHSNNSQTIHQSSPNTLKKTQNRTAFNKNNYMDKNFDLRKRCFALMGAAEDSRLDYDQNYNSVSGDISDGRGITAGIIGFTTGTGDMNDMLGYYNKISPNNHLAGYKDHMDHINGKQFEKDWHNAYKDDKDRFIKAQNHEVKKEVMNDAVKYAKKDGLSQLGQYIYFDALVKHGPGNNYQDAPREWGFQAIRHYAQENNVKTPSEGGDESKYLKNFVGKRYDATNDENDHNPDMDTDGTTDRLDFQMQQLDNGNLDLALPLSFKMNNTPFDLNQEKLNKLSDKDLASLND

SEQ ID NO: 42312 - protein, 171 aa, Staphylococcus epidermidis NIHLM008
KPSNPDKPSNPDKPSNPDKPSNPDKPSNPDKPGSPDKPSNPDKPGSPDKPSNPDKPSNPDKPGSPDKPSNPDKPGSPDKPSNPDKPQGTDNIDNGFNHDDNGNPIQPSNNVSHHSDSDKANSKSESADSKKQLPDTGSNDNNEGTLIGSLLAIVGSLFVFGRRKNKQNTEK

SEQ ID NO: 42313 - protein, 681 aa, Staphylococcus epidermidis NIHLM008; identical to SEQ ID NO: 42118

SEQ ID NO: 42314 - protein, 205 aa, Staphylococcus epidermidis NIHLM008; identical to SEQ ID NO: 39382

SEQ ID NO: 42315 - protein, 127 aa, Staphylococcus epidermidis NIHLM008
KPAESGKPVEPGKPVEPGTPAEPGKPAEPGKPAEPGKPAEPGTPAEPGTPAEPGKPAEPGTPAEPGTPAQSGAPEQPNRSMHSTDNKNQLPDTGENRQANEGTLVGSLLAIVGSLFIFGRRKKGNEK

SEQ ID NO: 42316 - protein, 127 aa, Staphylococcus epidermidis NIHLM008
MKNETKQKFGIRKFSVGVGSIIIGTVMFTGMGHNAHAAELDHDTTQPQTAQQQKDNTAEQQNNERAAQAQKDNAAEQQQNNERAAQQQKDNATEQQQNNERAVQQQKDNATEQQQNNERAAQQQKDN

SEQ ID NO: 42317 - protein, 85 aa, Staphylococcus epidermidis NIHLM008; identical to SEQ ID NO: 41995

SEQ ID NO: 42318 - protein, 931 aa, Staphylococcus epidermidis NIHLM008
MINKKNNLLTKKKPIANKSNKYAIRKFTVGTASIVIGATLLFGLGHNEAKAEENSVQDVKDSNTDDELSDSNDQSSDEEKNDVINNNQSINTDDNNQIIKKEETNNYDGIEKRSEDRTESTTNVDENEATFLQKTPQDNTHLTEEEVKESSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYGDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDS

SEQ ID NO: 42319 - protein, 697 aa, Staphylococcus epidermidis NIHLM008
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETASAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNPDQNNTPTNGQDGNQTGQGTQVKPNNDQTVTGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGDTDKDAKVNTDDDETKTDVKNDTELPETGLSNEYDYTTTVFGSIALISSLLLLRRQRKESK

SEQ ID NO: 42320 - protein, 219 aa, Staphylococcus epidermidis NIHLM008; identical to SEQ ID NO: 39379

SEQ ID NO: 42321 - protein, 434 aa, Staphylococcus epidermidis NIHLM008; identical to SEQ ID NO: 39380

SEQ ID NO: 42322 - protein, 25 aa, Staphylococcus epidermidis NIHLM008
MAADIISTIGDLVKWIIDTVNKFKK

SEQ ID NO: 42323 - protein, 327 aa, Staphylococcus epidermidis NIHLM008
MNWQRKCILTTLLVLSSLFLVFSTITYASERDFKDSLKITTHNVYFLPTAIYPNWGQSQRADLISKADYIQNQDVVILNELFDKKASKRLLTRLHSQYPYQTPIVGKGTEGWKNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42324 - protein, 213 aa, Staphylococcus epidermidis NIHLM008
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSEPTKAEEGGNAEAPQSEPTKTEEGSNVKQLNLSQRRQKKEAMQKHLNLSQRRQKKEATQKQLNLSQRRQKKGAMQ

SEQ ID NO: 42325 - protein, 688 aa, Staphylococcus epidermidis NIHLM008; identical to SEQ ID NO: 41949

SEQ ID NO: 42326 - protein, 728 aa, Staphylococcus epidermidis NIHLM008; identical to SEQ ID NO: 42295

SEQ ID NO: 42327 - protein, 235 aa, Staphylococcus epidermidis NIHLM008; identical to SEQ ID NO: 41955

SEQ ID NO: 42328 - protein, 291 aa, Staphylococcus epidermidis NIHLM008; identical to SEQ ID NO: 39372

SEQ ID NO: 42329 - protein, 3692 aa, Staphylococcus epidermidis NIHLM008
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITQTNVNVQKKPQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKVDNATTNNQIDGIVSDSRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQESINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNVLVDENLEDGKQKLQRIVLSTQTKTQAKADIAQAIGQQRSTIDQNQNATTEEKQEAHERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNAKNQLNQFIDNQKKIIENTPDATLEEKAEANRLLQNVLTSTSDEIANVDHNNEVDQALDKARPKIEAIVPQVSKKRDALNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEEKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMVSQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42330 - protein, 203 aa, Staphylococcus epidermidis NIHLM015
MKKTSILTTTILAGALLFSGLGAHQAHAAESEVTANNATEIGSSVMKEHGYHPENVNFREPEDKGNYYLISYGNKSGAGVGAVRVYKDGLVKSGAGALASTENADLDKVGYYQFATDQNSTSSSNIVNNEQQNQTADSNISAQNSQQQYSSTTEENNNSQLQVENNSLPETGEQSNSGLITVIASVLLAVGSLLTFKKTSKSN

SEQ ID NO: 42331 - protein, 190 aa, Staphylococcus epidermidis NIHLM015; identical to SEQ ID NO: 39373

SEQ ID NO: 42332 - protein, 291 aa, Staphylococcus epidermidis NIHLM015
MKKIDSWLTKHGLKNRLTLAVIVIFIIFLILLFMFVNLSDEDTGQITITENAELRTGPNAAYPVIYKIEKGESFKKIDRKGKWIEVQNHAGTEKGWVAGWYTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 42333 - protein, 728 aa, Staphylococcus epidermidis NIHLM015
MKNKKNSYSIRKLSVGASSIIVASMLFIGGGSVHAAESNHLENQEQSEVSASHSIELQHKDQEIQQPENKDNKNYHSETIDKNATIHNNDYSYHETPSTDVKSNEGKQIDSQSNQPQTSMTKNDQQNPKKVAEHTTKGINAKKEETRKNENAKSLVQPQQDDKTTSEQTKMKESREQEITNEQKQLQSKDVKNAQQENQNIDQEKSQEKINLQQSSIDKAQKSSRIDGKLDHQYNKDATQSNEGIASENVSEQHITAKDAGVTRNNRGDEHLNQEKSTTSSDKELKVDDIDKDLSTKESPENEKDDSRKGIKALTKNSQATTRNTATTEASKELKDQTNKVASQKEYKNHDPIILVHGFNGYASGTGPITGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42334 - protein, 235 aa, Staphylococcus epidermidis NIHLM015
MKKTVIASTLAVSLGIAGYGLSGHEAHASETTNVDKAHLVDLAQHNPEELNAKPVQAGAYDIHFVDNGYQYNFTSNGSEWSWSYTVAGSDADYTESSSNQEVSANTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 42335 - protein, 687 aa, Staphylococcus epidermidis NIHLM015
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTLPADQENNAPQAGAGTPGAENTPQAGGENHNQDNAVTAAGTSGEQNGGKPATSTTGQDAAQPNGPQGTSVAQPSNDASSQGHDTPQADAGTHNTEGQPAVTTGEQAGGKPAATKPEGADTETAPVPNTADENHAQPSPQSGGTTATQAGQVKPSGDSTPTGKPNTADDQGTQIKPTSNQGTTATTGETGNQKPSGQTGNTENTPNNGTQVKPNNNPAVTGTPNANEEQTGQPNATVTPGQGNDEINGATKPGEVSPKPEENNPAVTEPGTTAPGNTNQGTQVKPNPDQNNNPTTGQDTDQTDQGTQVKPNNDQTATGTQGATGDQNTQQGNTEQNNQNAEPSAPGTTDQAGATVKPGSAPNQDAEVKPNPDQNNNPTTGQDADQTGQSTQVKPNNDQTATGTQGATGDQNTQQGNTEQNNQNAEQGNTGQEGSNPNQSAQLGATVKPGSAPTQDTEVKPNPDQNNNPTTGQDADQTGQGTQVKPNNNQTATGTQGATGDQNTQQGNAGNKGNAGNKGNTGNADKDAKVNTNDDETKTDVKNGTELPETGLSNEYDYTTTVFGSIALISSLLLLRRQRKESK

SEQ ID NO: 42336 - protein, 434 aa, Staphylococcus epidermidis NIHLM015; identical to SEQ ID NO: 39380

SEQ ID NO: 42337 - protein, 3692 aa, Staphylococcus epidermidis NIHLM015
MNLFRKQKFSIRKFNIGIFSALIATVAFLAHPGQATASELEPFQNNDTTAQSDGGLENTSQSNPISEETTNTLSEQTVPSSTENKQTQNDPHHNAQPIAINAEEAESAQTAPYTNIYENNDTSDNGLHVNQPVKHHIEAQSEDVTNHTNSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDTGDPKNSQAIENVVALGRIHGNDVNDHGDFNGIEKEFNVNPNSELIFSFNTMTARNYKGGTNLVLRNAENNQEIATADVQGGGIYRLFKLPDNVYRIKVQFLPNNELMRDARRIYQLQDGYKYYSFIDTVGINSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLSRSSQDVARFLPNKVLNIRYKLRPVNISTPREVTFNEAIKYKTFSEYYINTTDNTVTGQQTPFSINVIMNKDDLSEQVNKDIIPSNYTLASYNKYNKLKERAQNVLDEETNNTPFNQRYSQTQIDDLLHELQTTLISRVSASREINDKAQEMTDGVYDSAELTTEEKDTLVDQIENHKNEISNNIDDELTDDGVERVKEAGLHTLESDTPHPVTKPNARQVVNNKAEQQKTLIRNNHEATTEEQNEAISQVEAHSSDAIAKIGEAETDTTVNEARDNGTKLIATDVPNPTKKAEAREAVTNSANSKIKDINNNTQATLDERNDAITLVNRSKDEAIQNINTAQGNDDVTEAQNNGTNTIQQVPLTPVKRQNAIATINAKADEQKRLIQANNNATTEEKADAERKVNEALLTATQNISNAPTNRDVDQAQTTGSGIISTISPATKIKEDARAAVEAKAIAQNQQINSNNMATTEEKQDALNQVEAHKQATITNINQAQSTQQVSEARNNGINTINQDQPNAVKKNNTKTLLEQKGNEKKSAIAQTPDATIEEKQEAVSVVSQAVTNGNNHINQANSNDDVDQALSNAEQIITHTDVNVQKKPQARQALIAKVNEKQSAINTDNEGTIEEKQKAIQSLNDVKNSADEQITQAASNQNVDNALNIGISNISKIQTNFTKKQQARDQVNQKFQEKEAELNSTPHATHDEKQDALTRLTQVKESILNDINQAQTNQNVDTALTNGIQNIQNIQVDVRKKQEARTTINDIVQQHKQTIQNNDDATTEEKEVANNLVNVSQQNVISKIDNATTNNQIDGIVSDGRQTINAITPDTSIKRNAKNDIDGKAADRKIKIQRINDATAEEIQEANRKIEEAKIEAKDNIQHSSTRDQVNEAKTNGINKIENITPATTVKSEARQAVQNKANEQINHIQNTPDATNEEKQEAINRVSAELARVQAQINAEHTTQGVKNIKDDAITSLSRINAQVVEKESARNAIEQKSTQQTQFINDNDNATDEEKEVANNLVIARKQNALDNINSLSSNSDIEIAKVTGINEIAKVLPATSVKSKAKKDIDQKLAQQINQIQTHQTTTIEEKEAAIQLANQKANEARTAIQNEHSNNGVAQAKSNGIHEIELVTPDAHKKSDAKQSIDDKYNEQSNTINTTPDATDEEKQKALDKLKIAKDAGYNKVDQAQTNQQVSDAKTEAIDTITNIQANVAKKPSARMELDSKFEDLKRQINATPNATEEEKQDAIQRLNVKREEVKNLINQDRRDNDVEQHKNTGLQELETIHANPTRKSDALQELQTKFISQTELINNNKDATNEEKAEAKRLLEISKNKTITNINQAQTNNQVDNAKDNGMNEIATIIPATTIKTDAKTAIDKKAEQQVTIINGNNDATDEEKAEARKLVEKAKTEVKSNITNSDTEREVNSAKTNGLEKINNIQPSTQTKTNAKQEINDKAQEQLIQINNTPDATEEEKQEATNRVNAGLAQAIQNINNAHSTQEVNESKTHSIATIKSILPNVIKKPTAINDLTQEANNQKTLIGNDGNATDDEKEAAKQLVTQKLNEEIQKIHESTQDNQVDNVKAQAITAIKLINANAHKRQDAINILTNLAESKKSDIRANQDATTEEKNTAIQSIDDTLAQARNNINGANTNVLVDENLEDGKQKLQRIELSTQTKTQAKADIAQAIGQQRSTIDQNQNATTEEKQEALERLNQDTNGVNDRIQAALANQNVTDEKNNILETIRNVEPIVVVKPKANENIRKKAAEQTTLINQNQDATLEEKQIALGKLEEVKNEALNQVSQAHSNNDVKIAENNGIAKISEVHPETSIKRNAKQEIEQVAQSQIDTINANNKSTNEEKSAAIDRVNVAKIDAINNIANATTTQLVNDAKNNGNTSITQILPSTAVKTNALAALATEAKNKNAIIDQTPNATAEEKEEANNKVDGLQEEADANILKAHTTEEVNNIKNQAVQNINAVQVEVIKKQNVKNQLNQFVDNQKKIIENTPDATLEEKAEANRLLQNVLTSASDEIANVVHNNEVDQALDKARPKIEAIVPQVSKKRDALNAIQEAFNSQTQEIQENQEATNEEKTEALNKINQLLNQAKVNIDQAQSNKDVDNAKTRIIQDIEQIQAHPQTKETGRHRLNEKANQQQSTIATHPNSTIEERQEASAKLQEVLKKAIAKIDKGQTNDDVEKTVVNGIAEIENILPTTTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATDDEVREGLNQLNQIHEKAKNDVNQSQTNQQVENAEQNSLDLINNFRPDFSKKRNAVAEIVKAQQNKIDEIEQEFSATQEEKDNALQHLDEQVKEIINSINRANTDNEVDNAKTSGLNNINEYRPEYNKKKNAILKLYDVSDTHEAIINGYPDATEDELQEANSKLNKILLDAKKQIGLAHTNNEVDDIYNEVSQKMKTILPRVDTKAVARSVLNALAKQLIKTFENTPDVTHEERNDAINHVKEQLSLVFNAIEKDQKDIQVAQDELFGLNELNSIFINITQKPTARKAISDKASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNQSFITINNVNKNQEVYDTKNKTIEAIHKIKPITIIKPQALNEITNQLDAQRDLIKNNNESTVEEKASAIDKLIKTAARIAEAIDKAQTNEDVKNIKKQSIDEISKILPVIEIKLAARNEIHQKAEVIRGLINNNEEATKEEKDVALNQLDTTLTQANLSIDQALTNEAVNRAKEIATSEINKISVITIKKPEAIAEIQELADKKLNKFKQNQEATIEENQSAINELEQALKSAINHIHQSQNNESVSAALKESISLIDSIEIQAHKKLEAKAYIDGYSDDKINDISSRATNEEKQIFVSKLKALINHAHKQIDEAETFVSVDTIVRNFKVEVDKLNSIVRKKAKALKEIELEADHVKQMINANLSASTRVKQNARTLINEIVSNALSQLNKVTTNKEVDELVNETIEKLKSIQLREDKILSSQRSTTSMTEKSNQCYSSENNTIKSLPETGNVDKSVPLAGVTLISGLAIMSSRKKKKDKKVND

SEQ ID NO: 42338 - protein, 1006 aa, Staphylococcus epidermidis NIHLM015
MINKKNNLLTKKKPIANKSNKYAIRKFTVGTASIVIGATLLFGLGHNEAKAEENTVQDVKDSNTDDELSDSNDQSSNEEKNDVINNSQSINTDDDNQINKKEETNSNDAIENRSKDITQSTTNVDENEATFLQKTPQDNTQLKEEVVKEPSSVESSNSSMDTAQQPSHTTINSEASIQTSDNEENSRVSDFANSKIKEINTESDKEENTIEQPNKVREDSTTSQPSSYRNIDEKISNQDELLNLPINEYENKARPLSTTSAQSPIKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGIPGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 42339 - protein, 219 aa, Staphylococcus epidermidis NIHLM015; identical to SEQ ID NO: 42003

SEQ ID NO: 42340 - protein, 25 aa, Staphylococcus epidermidis NIHLM015
MAADIISTIGDLVKWIIDTVNKFKK

SEQ ID NO: 42341 - protein, 681 aa, Staphylococcus epidermidis NIHLM015
MKNNNRIKRFSIRKYAVGVVSIITGVTIFIGGQQAQAAEISVQHADAHPEDSQTTQQLKNDKVEETLKASKQGTADSQQVQRIDQSKTNQNNQHSVAESAQLKSDETANQPKVEEESSVKQDVQPSKNVNQQDVATQSNERENNDIKGESQTSKASNQHTQSSNSHNQSIGTKDSDSEELDQPLVKLQKPSNDSTYQTQSKAKQDSSKQLPQEKTTKHQIQTTENEQTTNVDSKKANDTQDARQHTQEPKNDTSTSQKNHHQVATKEQSNRSTTRETQKQSANSNQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQVFKKVDDHTPATDKGVWQVRPVQHDWDHLDLVGMDAFDLTHTGRELGQFYLGIMDNIMRIEEADGITNK

SEQ ID NO: 42342 - protein, 327 aa, Staphylococcus epidermidis NIHLM015
MNWQRKCILTTLLVLSSLFLVFSTITYASERDYKDSLKITTHNVYFLPTAIYPNWGQSQRADLISKADYIQNQDVVILNELFDKKASKRLLARLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42343 - protein, 132 aa, Staphylococcus epidermidis NIHLM015
MKKKLDFLPNKLNKYSIRRFTVGTASILVGSTLLFGIGNEAHAAEEHQKSNTTENVADSNASEAPTKEEAPSNEATSEAPTKEEVPSNEATREAPTKEEAPSNEATSEAPTKEEAPSNEATREAPTTEEAPS

SEQ ID NO: 42344 - protein, 129 aa, Staphylococcus epidermidis NIHLM015
DADSDSDADSDSDADSDSDADSDSDADSDSDADSDSDADSDSDADSDSDADSDSDADSDSDSDSDSDADSDSDADRDHNDKTDKPNNKELPDTGNDAQNNGTLFGSLFAALGGLFLVGRRRKNKNNEEK

SEQ ID NO: 42345 - protein, 190 aa, Staphylococcus epidermidis NIHLM015
MKKVLALLFASTLILGACGDKNDESKNDSSSNSTDSVSVDKNDNEDKTTAKFKNDKLTTDNFDIEILEAKTVKASEYDDDKKPSIAIIYGVKNKKDKDLTASSAFIESFDIYQNSKDVKRRLEIGGGYDTDLKEKYEEDMDNKINKDGKVKGVMFFKLKDTKTPVTLEAKDPNHSNNEKVGTKEFKIKEK

SEQ ID NO: 42346 - protein, 599 aa, Staphylococcus epidermidis NIHLM015
MKTRQNKYSIRKFSVGASSILIAALLFMGGGSAQAAEQQQDKGTVENSTTQSIGDKNEKLSEQQSTQNKNVNEKSNVNSITENENLHNETPKNEDLIQQQKDSQNDNKSESVVEQNKKNEAFVQNHSEEKPQQEQVELEKHASENNQTLHSNAAQSNEDVKTKPSQLDNTTAQQEDSQKESLSKQDTQSSKNTDLLRTTGQNQSKDSQSTEEVNKEVNNDTQQVTAKKDDDKVETFNLNSKEEPLKVDKQANPTTDKDKSSKNDKGSQDGLANLESNAVATTNKQSKQQVSEKNEDQTNKSAKQKQYKNNDPIILVHGFNGFTDNINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLVYDVGKMYGNKDSRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGK

SEQ ID NO: 42347 - protein, 1024 aa, Staphylococcus epidermidis NIHLM018
MINKKNNLLTKKKPIANKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDNDSDLGNSSDKSTKDKLPDTGANEDYGSKGTLLGTLFAGLGALLLGKRRKNRKNKN

SEQ ID NO: 42348 - protein, 25 aa, Staphylococcus epidermidis NIHLM018
MAADIISTIGDLVKWIIDTVNKFKK

SEQ ID NO: 42349 - protein, 146 aa, Staphylococcus epidermidis NIHLM018
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAAQSEPTKAEEGGNAEAPQSEPTKAEEGGNAEAPQSEPTKAEEG

SEQ ID NO: 42350 - protein, 219 aa, Staphylococcus epidermidis NIHLM018; identical to SEQ ID NO: 39379

SEQ ID NO: 42351 - protein, 434 aa, Staphylococcus epidermidis NIHLM018; identical to SEQ ID NO: 39380

SEQ ID NO: 42352 - protein, 517 aa, Staphylococcus epidermidis NIHLM018
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTQAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQ

SEQ ID NO: 42353 - protein, 118 aa, Staphylococcus epidermidis NIHLM018
SDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGALFAGLGALLLGRRRKKDNKEK

SEQ ID NO: 42354 - protein, 3692 aa, Staphylococcus epidermidis NIHLM018
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIVTDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKVNEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDVKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAKANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42355 - protein, 327 aa, Staphylococcus epidermidis NIHLM018; identical to SEQ ID NO: 42020

SEQ ID NO: 42356 - protein, 681 aa, Staphylococcus epidermidis NIHLM018
MTNNNRIKRFSIRKYAVGVVSIITGVTIFIGGQQAQAAETSVQHADAHPEDSQTTQQLKNDKVEETLKASKQGNADSQQVQTIDQSKTNQNNQHSVTESAQLKSDETANQPKKEEGSSVKQDVQPSKNVNQQDVATQSNERENNDIKGEGQTSKTSNQHIQSSNSHNQSTGTKDSYSEEIDQPLVKLQKPSNDSTYQTQSKTKQDSSKQLPQEKTTKRQIQTTENEQTTKADSKKANDTQNVEKHTQEPKNDTSTSQKNHHQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42357 - protein, 343 aa, Staphylococcus epidermidis NIHLM018; identical to SEQ ID NO: 39377

SEQ ID NO: 42358 - protein, 112 aa, Staphylococcus epidermidis NIHLM018
EPGTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42359 - protein, 728 aa, Staphylococcus epidermidis NIHLM018; identical to SEQ ID NO: 39721

SEQ ID NO: 42360 - protein, 688 aa, Staphylococcus epidermidis NIHLM018; identical to SEQ ID NO: 41929

SEQ ID NO: 42361 - protein, 291 aa, Staphylococcus epidermidis NIHLM018; identical to SEQ ID NO: 39372

SEQ ID NO: 42362 - protein, 235 aa, Staphylococcus epidermidis NIHLM018; identical to SEQ ID NO: 41955

SEQ ID NO: 42363 - protein, 476 aa, Staphylococcus epidermidis NIHLM018
MSKLSTLKTYNFQITSNNKEKTSRIGVAIALNNRDKLQKFSIRKYAIGTFSTVIATLVFMGINTNHASADELNQNQKLIKQLNQTDDDDSNTHSQEIENNKQNSSGKTESLRSSTSQNQANARLSDQFKDTNETSQQLPTNVSDDSINQSHSEANMNNEPLKVDNSTMQAHSKIVSDSDGNASENKHHKLTENVLAESRASKNDKEKENLQEKDKSQQVHPPLDKNALQAFFDASYHNYRMIDRDRADATEYQQVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFS

SEQ ID NO: 42364 - protein, 235 aa, Staphylococcus epidermidis NIHLM020; identical to SEQ ID NO: 41955

SEQ ID NO: 42365 - protein, 345 aa, Staphylococcus epidermidis NIHLM020
TTTDESGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42366 - protein, 327 aa, Staphylococcus epidermidis NIHLM020; identical to SEQ ID NO: 42020

SEQ ID NO: 42367 - protein, 931 aa, Staphylococcus epidermidis NIHLM020; identical to SEQ ID NO: 42185

SEQ ID NO: 42368 - protein, 25 aa, Staphylococcus epidermidis NIHLM020
MAADIISTIGDLVKWIIDTVNKFKK

SEQ ID NO: 42369 - protein, 554 aa, Staphylococcus epidermidis NIHLM020
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASIQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEQGNTGQEGSNPNQSGQLGATVKPGSAPNQDTEVKPNPDQNNNPTNG

SEQ ID NO: 42370 - protein, 434 aa, Staphylococcus epidermidis NIHLM020; identical to SEQ ID NO: 39380

SEQ ID NO: 42371 - protein, 728 aa, Staphylococcus epidermidis NIHLM020; identical to SEQ ID NO: 41977

SEQ ID NO: 42372 - protein, 681 aa, Staphylococcus epidermidis NIHLM020; identical to SEQ ID NO: 41996

SEQ ID NO: 42373 - protein, 219 aa, Staphylococcus epidermidis NIHLM020; identical to SEQ ID NO: 39379

SEQ ID NO: 42374 - protein, 688 aa, Staphylococcus epidermidis NIHLM020; identical to SEQ ID NO: 41929

SEQ ID NO: 42375 - protein, 85 aa, Staphylococcus epidermidis NIHLM020; identical to SEQ ID NO: 41995

SEQ ID NO: 42376 - protein, 821 aa, Staphylococcus epidermidis NIHLM020
MKNKQGFLPNLLNKYGIRKLSAGTASLLIGATLVFGINGQVKAAETDNIVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLSNDANHQTTDEVNHSDSDNMTNSTPNDTENELDTTQLTSHDESPSPQSDNFTGFTNLMATPLNLRNDNPRINLLAATEDTKPKTYKKPNNSEYSYLLNDLGYDATTVKENSDLRHAGISQSQDNTGSVIKLNLTKWLSLQSDFVNGGKVNLSFAQSDFYTQIESITLNDVKMDTTNNGQNWSAPINGSTVRSGLIGSVTNHDIVITLKNSQTLSSLGYSNNKPVYLTHTWTTNDGAIAEESIQVASITPTLDSKAPNTIQKSDFTAGRMTNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSGQLSNARTSLDRNVFFGTLGQSRSYTISYKLKDGYTLESVASKVSARETFDSWMEVDYLDSYDSGAPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENG

SEQ ID NO: 42377 - protein, 291 aa, Staphylococcus epidermidis NIHLM020; identical to SEQ ID NO: 42183

SEQ ID NO: 42378 - protein, 3692 aa, Staphylococcus epidermidis NIHLM020; identical to SEQ ID NO: 42099

SEQ ID NO: 42379 - protein, 140 aa, Staphylococcus epidermidis NIHLM021
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSEP

SEQ ID NO: 42380 - protein, 434 aa, Staphylococcus epidermidis NIHLM021; identical to SEQ ID NO: 39380

SEQ ID NO: 42381 - protein, 264 aa, Staphylococcus epidermidis NIHLM021
MDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42382 - protein, 134 aa, Staphylococcus epidermidis NIHLM021
SDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 42383 - protein, 25 aa, Staphylococcus epidermidis NIHLM021
MAADIISTIGDLVKWIIDTVNKFKK

SEQ ID NO: 42384 - protein, 291 aa, Staphylococcus epidermidis NIHLM021; identical to SEQ ID NO: 39372

SEQ ID NO: 42385 - protein, 235 aa, Staphylococcus epidermidis NIHLM021; identical to SEQ ID NO: 41955

SEQ ID NO: 42386 - protein, 343 aa, Staphylococcus epidermidis NIHLM021; identical to SEQ ID NO: 39377

SEQ ID NO: 42387 - protein, 205 aa, Staphylococcus epidermidis NIHLM021; identical to SEQ ID NO: 42164

SEQ ID NO: 42388 - protein, 681 aa, Staphylococcus epidermidis NIHLM021
MTNNNRIKRFSIRKYAVGVVSIITGVTIFIGGQQAQAAETSVQHADAHPEDSQTTQQLKNDKVEETLKASKQGNADSQQVQTIDQSKTNQNNQHSVTESAQLKSDETANQPKKEEGSSVKQDVQPSKNVNQQDVATQSNERENNDIKGEGQTSKTSNQHIQSSNSHNQSTGTKDSDSEEIDQPLVKLQKPSNDSTYQTQSKTKQDSSKQLPQEKTTKRQIQTTENEQTTKADSKKANDTQNVEKHTQEPKNDTSTSQKNHHQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHGWDHLDLVGMDAFDLTHTGRELGQFYLGIMDNIMRIEEADGITNK

SEQ ID NO: 42389 - protein, 327 aa, Staphylococcus epidermidis NIHLM021; identical to SEQ ID NO: 42156

SEQ ID NO: 42390 - protein, 688 aa, Staphylococcus epidermidis NIHLM021; identical to SEQ ID NO: 39381

SEQ ID NO: 42391 - protein, 728 aa, Staphylococcus epidermidis NIHLM021; identical to SEQ ID NO: 39721

SEQ ID NO: 42392 - protein, 219 aa, Staphylococcus epidermidis NIHLM021; identical to SEQ ID NO: 39379

SEQ ID NO: 42393 - protein, 213 aa, Staphylococcus epidermidis NIHLM021
MGEKFNNEQEERQFRQFQEYQKQQEEEKKKKRKKGWLFGCGGCLVLLILIIVGISACTATITGGSDNSSDNKTHKMGEKVKNGDLEVTVNSVETKDSVGSQYAPTTPKGTFVVANVSIKNNGDKALTVDSNMFTLKNKDKSYDADGGASMSANQSDDGNIENSFFLEQVNPDSTTEGYVVFDVSDKVANTKDKKLEITSSLFSSKGVTFDLSE

SEQ ID NO: 42394 - protein, 469 aa, Staphylococcus epidermidis NIHLM021
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQDTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNTDQNNTPTNGQDGNQT

SEQ ID NO: 42395 - protein, 291 aa, Staphylococcus epidermidis NIHLM023
MKKIDSWLTKHGLKNRLTLVVIAIFIIFLILLFMFVNLSDEDTGQITITDNAELRTGPNAAYPVIYKIDKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 42396 - protein, 25 aa, Staphylococcus epidermidis NIHLM023
MAADIISTIGDLVKWIIDTVNKFKK

SEQ ID NO: 42397 - protein, 403 aa, Staphylococcus epidermidis NIHLM023
KGKPTIKVDDPSKLPDGNTPGTVNVPVTVTYPDGTQDHVTVPVTTNKQADNDAYEPTTDEVTKDYGTPTTEDDVTGAVTIPNYPSEKGKPTIKVDDPSTLPDGNTPGTSNVDVTVTYPDGTQDHVTVPVTTNPEKDVIAPDAPTINQPSVGDKTISGKGEPGSTITVTFPDGSTTTGKVDGNGDWTVTVPDEITLHEGDKITAISTDDSGNKSNPTDTTVVDHDDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKDVDKDHSDKEALPQTGEQSNSNNATLFGSLFAGLGSLFLFGRRRKKDADNK

SEQ ID NO: 42398 - protein, 98 aa, Staphylococcus epidermidis NIHLM023
MSTSTSVSDSNSMSASTSESNITSNATSNSASNGESTNSSNVAQQSDHKDNSDETKELPETGNRNDTNNTNVLMGAVLSLLAGLGLVKKSRKNKEDKK

SEQ ID NO: 42399 - protein, 928 aa, Staphylococcus epidermidis NIHLM023
MFGLGHNEAKAEENTVQDVKDSNMDDELSDSNDQSSNEEKNDVINNSQSINTDDDNQIKKEETNSNDAIENRSKDITQSTTNVDENEATFLQKTPQDNTQLKEEVVKEPSSVESSNSSMDTAQQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEKGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSDSDSDSDSDSDSDSDSDSDSDSDSDSDSDSDSDSDSDSASDSDSDSDSGLDNSSDKNTKDKLPDTGANEDHDSKGTLLGALFAGLGALLLGKRRKNRKNKN

SEQ ID NO: 42400 - protein, 235 aa, Staphylococcus epidermidis NIHLM023
MKKTVIASTLAVSLGIAGYGLSGHEAHASETTNVDKAHLVDLAQHNPEELNAKPVQAGAYDIHFVDNGYQYNFTSNGSEWSWSYTVAGSDADYTESSSNQEVSSNAQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 42401 - protein, 219 aa, Staphylococcus epidermidis NIHLM023; identical to SEQ ID NO: 42003

SEQ ID NO: 42402 - protein, 405 aa, Staphylococcus epidermidis NIHLM023
MKDIKPNNSKLIQTYLSKKTIRYGTASALTLALYLFNSNVTVYADENTANQGTSPKTSQTAPTNNNENTDATAVTTDQNNNDEEEYDASYELPILYVTVWLDDQGNIIKDAVEDAKTPASERQPVKIPGYQHYRTSVSDGITKFIYRKISTAQSPIVENNQQNNNTNNVVETTNQNKDEVNGKEQNQANTSVTNTQITKNEKDEDTKTLQKDKDEKESKDTKTPKKDKENKDTKTPKKDKENKDTKTPKKDREEKKPVITSNGKDEKDEDRKTPKKDKEEKITKTPKKDREEKKPVIPSNGKVEKDEDRKTSKKDKEEKITKTSKKEREEKSPAIPKSDIDEKDTKITKKDKVDEITTTSKKDNNNDVQDKLPETGKSNDIQNPALIMLLAGLGLLGLFRNKIRE

SEQ ID NO: 42403 - protein, 434 aa, Staphylococcus epidermidis NIHLM023; identical to SEQ ID NO: 39380

SEQ ID NO: 42404 - protein, 600 aa, Staphylococcus epidermidis NIHLM023
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTLPADQENNAPQAGAGTPGAENTPQAGGENHNQDNAVTAAGTSGEQNGGKPATSTTGQDAAQPNGPQGTSVAQPSNDASSQGHDTPQADAGTHNTEGQPAVTTGEQAGGKPAATKPEGADTETAPVPNTADENHAQPSPQSGGTTATQAGQVKPSGDSTPTGKPNTADDQGTQIKPTSNQGTTATTGETGNQKPSGQTGNTENTPNNGTQVKPNNNPAVTGTPNANEEQTGQPNATVTPGQGNDEINGATKPGEVSPKPEENNPAVTEPGTTAPGNTNQGTQVKPNPDQNNNPTTGQDTDQTGQSTQVKPNNDQTATGTQGATGDQNTQQGNTEQNNQNAEQGNTGQEGSNPNQSGQLGATVKPGSATNQDTEVKPNPDQNNKPTTGQDADQTGQSTHVKPNNNQTATGTQDAIGDQNTQQGNAGNKGNAGNKGNTDKDAKVNTNDDETKTDVKNGTELPETGLSNEHDYTTTVFGSIALISSLLLLRRQRKESK

SEQ ID NO: 42405 - protein, 3692 aa, Staphylococcus epidermidis NIHLM023
MNLFRKQKFSIRKFNIGIFSALIATVAFLAHPGQATASELEPSQNNDTTAQSDGGLENTFQSNPISDETTNTLSEQTVPSSTENKQTQNDPHHNNQPIAINAEEAESAQTPPYTNIYENNDTSDNGLHVNQPVKHHIEAQSEDVTNHTNSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELLTTLISRVSASREINDKAQEMTDGVYDSTELTTEEKDTLVDQIENHKNEISNNIDDELTDDGVERVKEAGLHTLESDTPHPVTKPNARQVVNNKAEQQKTLIRNNHEATTEEQNEAISQVEAHSSDAIAKIGEAETDTTVNEARDNGTRLIATDIPNPTKKAEAREAVTNSANSKIKNINNNTQATLDERNDAITLVNRSKDEAIQNINTAQGNDDVTEAQNNGTNTIQQVPLTPVKRQNAIATINAKADEQKRLIQANNNATTEEKADAERKVNEALLTATQNISNAPTNRDVDQAQTMGSGIISTISPATKIKEDARVAVEAKAIAQNQQINSNNMATTEEKQDALNQVEAHKQATIANINQAQSTQQVSEAKNNGINTINQDQPNAVKKNNTKTLLEQKGNEKKSAIAQTPDATTEEKQEAVSVVSQAVTNGNNHINQANSNDDVDQALSNAEQIITHTDVNVQKKPQARQALIAKVNEKQSAINTDNEGTIEEKQKAIQSLNDAKNSADEQITQAASNQNVDNALNIGISNISKIQTNFTKKQQARDQVNQKFQEKEAELNSTPHATQDEKQDALTRLTQVKESTLNDINQAQTNQNVDTALTNGIQNIQNIQVDVRKKQEARTTINDIVQQHKQTIQNNDDATTEEKEVANNLVNVSQQNVISKIDNATTNNQIDGIVSDGRQTINAITPDTSIKRNAKNDIEGKAADRKIKIQRINDATAEEIQEANRKIEEAKIEAKDNIQHSSTRDQVNEAKTNGINKIENITPATTVKSEARQAVQNKANEQINHIQNTPDATNEEKQEAINRVSAELARVQAQINAEHTTQGVKNIKDDAITSLSRINAQVVEKESARNAIEQKSTQQTQFINDNDNATDEEKEVANNLVIARKQNALDNINSLSSNSDIENAKVTGINEIAKVLPATSVKSKAKKDIDQKLAQQINQIQTHQTATIEEKEAAIQLANQKANEARTAIQNEHSNNGVAQAKSNGIHEIELVTPDAHKKSDAKQSIDDKYNEQSNTINTTPDATDEEKQKALDKLKIAKDAGYNKVDQAQTNQQVSDAKTEAIDTITNIQANVAKKPSARMELDSKFEDLKRQINATPNATEEEKQDAIQRLNVKREEVKNLINQDRRDNDVEQHKNTGLQELETIHANPTRKSDALQELQTKFISQTELINNNKDATNEEKAEAKRLLEISKNKTITNINQAQTNNQVDNAKDNGMNEIATIIPATTIKTDAKTAIDKKAEQQVTIINGNNDATDEEKAEARKLVEKAKTEVKSNITNSDTEREVNSAKTNGLEKINNIQPSTQTKTNAKQEINDKAQEQLIQINNTPDATEEEKQEATNRVNAGLAQSIQNINNAHSTQEVNESKTHSIATIKSILPNVIKKPTAINDLTQEANNQKTLIGNDGNATDDEKEAAKQLVTQKLNEEIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQDTNGVNDRIQAALANQNVTDEKNNILETIRNVEPIVVVKPKANEIIRKKAAEQTTLINQNQDATLEEKQIALGKLEEVKNEALNQVSQAHSNNDVKIAENNGIAKISEVHPETSIKRNAKQEIEQVAQSQIDTINANNKSTNEEKSAAIDRVNVAKIDAINNIANATTTQLVNDAKNNGNTSITQILPSTAVKTNALAALATDAKNKNAIIDQTPNATAEEKEEANNKVDRLQEEADANILKAHTTEEVNNIKNQAVQNINAVQVEVIKKQNVKNQLNQFVDNQKKIIENTPDATLEEKAEANRLLQNVLTSASDEIANVVHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQAHPQTKETGRHRLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATDDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINRANTDNEVDNAKTSGLNNINEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTPDVTHEERNDAINHVKEQLSLVFNAIEKDQKDIQVAQDELFGLNELNSIFINITQKPTARKAISDKASQLNNSINNTPYATEEERQIALNKVKAIVEDANEKIREANTDSEVLGTKSNAITLLQAISADVQVKPQAFEEINAQAEIQRERINGNSDATREEKEEALKQVDTLVNKSFITINNVNKNQEVYDTKNKTIEAIHKIKPITIIKPQALNEITNQLDAQRDLIKNNNESTLEEKASAIDKLIKTAARIAEAIDKAQTNEDVKNIKKQSIDEVSKILPVIEIKLAARNEIHQKAEVIRGLINNNEEATKEEKDVALNQLDTTLTQANLSIDQALTNEAVNRAKEIATSEINKISVITIKKPEAIAEIQELADKKLNKFKQNQEATIEEKQSAINELDQALKSAINHIHQSQNNESVSAALKESISLIDSIEIQAHKKLEAKAYIDGYSDDKINDISSRATNEEKQIFVSKLKALINRAHKQIDEAETFVSVDTIVRNFKVEVDKLNSIVRKKAKALKEIELEADHVKQMINANLSASTRVKQNARTLINEIVSNALSQLNKVTTNKEVDELVNETIEKLKSIQLREDKILSSQRSTTSMTEKSNQCYSSENNTIKSLPETGNVDKSVPLAGVTLISGLAIMSSRKKKKDKKVND

SEQ ID NO: 42406 - protein, 327 aa, Staphylococcus epidermidis NIHLM023; identical to SEQ ID NO: 42342

SEQ ID NO: 42407 - protein, 681 aa, Staphylococcus epidermidis NIHLM023
MKNNNRIKRFSIRKYAVGVVSIITGVTIFIGGQQAQAAEISVQHADAHPEDSQTTQQLKNDKVEETLKASKQGTADSQQVQRIDQSKTNQNNQHSVAESAQLKSDETANQPKVEEESSVKQDIQPSKNVNQQDVATQSNERENNDIKGEDQTSKASNQHTQSSNSHNQSIGTKDSDSEEIDQPLVKLQKPSNDSTYQTQSKAKQDSSKQLPQEKTAKHQIQTTENEQTTNVNSKKANDTQDARQHTQEPKNDTSRLQKNHHKVATKEQSNRSTTRETQKQSANSNRNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42408 - protein, 688 aa, Staphylococcus epidermidis NIHLM023
MKTRQNKYSIRKFSVGASSILIAALLFMGGGSAQAAEQQQDKGTVENSTTQSIGDKNEKLSEQQSTQNKNVNEKSNVNSITENENLHNETPKNEDLIQQQKDSQNDNKSESVVEQNKKNEAFVQNHSEEKPQQEQVELEKHASENNQTLHSNAAQSNEDVKTKPSQLDNTTAQQEDSQKENLSKQDTQSSKNTDLLRTTGQNQSKDSQSTEEVNKEVNNDTQQVTAKKDDDKVETFNLNSKEEPLKVDKQANPTTDKNKSSKNDKGSQDGLANLESNAVATTNKHSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLVYDVGKMYGNKDTRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42409 - protein, 190 aa, Staphylococcus epidermidis NIHLM023
MKKVLALLFASTLVLGACGDKNDESKNDSSSNSTDSVSVDKNDNEDKTTAKFKNDKLTTDNFDIEILEAKTVKASKYDDDKKPSIAIIYGVKNKKDKDLTASSAFIESFDIYQNSKDVKRSLEIGGGHDTDLKEKYEENMGNKINKDGKVKGVMFFKLKDTKTPVTLEAKDPNHSYNGKVGTKEFKIKEN

SEQ ID NO: 42410 - protein, 128 aa, Staphylococcus epidermidis NIHLM023
MKKTRKKLDFLPNKLNKYSIRKFTVGTASILVGATLIFGAGHNVAEATEEDGSTNQSSTEDKTTSESTETNQSPTEDKTTSESTETNQSSTEDKTTSESTETNQSSTEDKTTSESTETNQSPTEDKTT

SEQ ID NO: 42411 - protein, 327 aa, Staphylococcus epidermidis NIHLM031
MNWQRKCILTTLLVLSSLFLVFSTITYASERHYKDSLKITTHNVYFLPTAIYPNWGQSQRADLISKADYIQNQDVVILNELFDKKASKRLLARLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42412 - protein, 114 aa, Staphylococcus epidermidis NIHLM031
SDSDSDSDSDADSDSDSDSDSDSDSDSDSDSDSDSDSDSDSDSDSDSDSDSDSDSDSDSDSDSDADSDKNAKDKLPDTGANEDHDSKGTLLGTLFAGLGALLLGRRRKKDNKEK

SEQ ID NO: 42413 - protein, 681 aa, Staphylococcus epidermidis NIHLM031
MKNNNRIKRFSIRKYAVGVVSIITGVTIFIGRQQAQAAEISVQHADAHPEDSQTTQQLKNDKVEETLKDSKQGTADSQKVQTIDQSKTNQNNQHSVAESAQLKSDETANQPKVEEESSVKQDIQPSKNVNQQDVATQSNERENNDIKGEDQSSKASNQHTQSSNSHNQSIGTKDSDSEEIDQPLVKLQKPSNDSTYQTQSKAKQDSSKQLPQEKTTKHQIQTTENEQTTNVDSKKTNDTQDARQHTQEPKNDTSTSQKNHHQVATKEQSNRSTTRETQKQSANSNQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRNWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42414 - protein, 219 aa, Staphylococcus epidermidis NIHLM031; identical to SEQ ID NO: 42003

SEQ ID NO: 42415 - protein, 145 aa, Staphylococcus epidermidis NIHLM031
DSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRLDNSSDKNTKDKLPDTGANEDHDSKGTLLGALFAGLGALLLGKRRKNRKNKN

SEQ ID NO: 42416 - protein, 235 aa, Staphylococcus epidermidis NIHLM031; identical to SEQ ID NO: 42077

SEQ ID NO: 42417 - protein, 431 aa, Staphylococcus epidermidis NIHLM031
VTTTDESGNSETTTFTIEVKDTTKPTVEDIADQTQEVNTEIEPIKIEAKDNSGQAVTNKVEGLPAGVTFDEATNTISGTPTEVGKYLITITTIDKDGNTATTTLTINIIDTTAPEQPTINKVTENSTEVSGRGEPGTIVEVTFPDGNKVEGKVDSDGNYHIQVPSETTLKGGQPLQVIAIDKAGNKSETTTTTVIDTTAPEQPTINKVTENSTEVSGRGEPGTIVEVTFPDGNKVEGKVDSDGNYHIQIPSDEKFKVGQQLIVKVVDEEGNVSEPSIATVHEEDKNSEKPGTVTDTVTKNNSKSLKHKASEQQSYHNKSEKIMSVNKPTKIVEKDMSTYDYSRYSKDISNKNNKSATFEQQNVSDINNNQYSRNKVNQPVKKSRTNEINKDLPQTGEENLNKSTLFGTLVASLGALLLFFKRRKKDEDGKE

SEQ ID NO: 42418 - protein, 612 aa, Staphylococcus epidermidis NIHLM031
MKKSSKFSKDFPTRKNHYSIRKFTVGTASIIVGSFLFFGQTQAHAEEFERVTTGTVDTGGQPARADQGQEGPQAGADTHNTASQPGATGQDAPNENHAGDQNAAVTHPADQENNAPQAGVGTPGAENTPQAGGENHNQDNAVTAAGTSGEQNGGKPATSTTGQEAAQPNGPQGTSVAQPGNDASSQGHDTPQADAGTHNTEGQPAVTTGEQASGKPAATKPEGAGTETAPAPNTADQSHAQPSPQSGGTTATQAGQVKPSGDSTPTGKPNTADDQGTQIKPTSNQGTTVTTGETGNQKPSGQTGNTENTPNDGTQVKPNNDPAATGTPNANEEQTGQPNATVTPGQGNDEINGATKPREVSPKPEENNPAVTEPGTTAPGNTNQGTQVKPNPDQNNNPTTGQDADQTGQGTQVKPNNNQTATGTQGATGDQNTQQGNTEQNNQNAEQGNTGQEGSNPNQNAQLGATVKPGSAPTQDTEVKSNPDQNNKPTTGQDADQTGQSTHVKPNNGQTPTGTQGANGDQNMQQGNAGNAGNAGNTGNAGNAGNAGNKGNTDKDAKVNTNDDETKADVKNSTELPETGLSNEYDYTTTVFGSIALISSLLLLRRQRKESK

SEQ ID NO: 42419 - protein, 940 aa, Staphylococcus epidermidis NIHLM031
MKNKQGFLPNLLNKYGIRKLSAGTASLLIGATLVFGINGQVKAAETDNTFSQNEDNKTNDSESSDEELVKSEDNQTSNTSTDTTLESEFEQNNNPSSIEESTNRNDEDTLSQRTSTETETDTHIKSADTQTTNETTNKNDDNATTNHTESTSDESTYQSDDLNTTQHDNSNTNQDTQSTLNPTSKESSNKDEATSSTPKESNNIEKTSLSNDTNHQTTDEVNHSDSNNMTNSTPNDIENELHTTQLTSHDESPSPQSDNFTGFTNLMATPLNLRNDNPRINLLAATEDTKPKTYTKPNNSEYSYLLNDLGYDATTVKENSNLRHAGISQSQDNTGSVIKLNLTKWLSLQSNFVNGGKVNLSFAQSDFYTQIESITLSGVKMDTTNNGQNWSAPINGSTVNSGEIGSVTNHEILITLKNSQTLSSLGYSNNRPVYLTHTWTTNDGAIAEESIQVASITPTLDSKAPNTTQKSGFTAGRVINKIKYDSSQKSIKSVHTFKPNENFLQTDYRAVLYVKEQVNKELIPYIDPNSVKLYVSDPDGKPISQDRYVNGSIDNDGLFDSSKINEISIKNNNTSDQLSNARTSLDKNVFFGTLGQSRSYTISYKLKDGYTLESVASKVSARETFDSWMEVDYLDSYDSGAPNKRLFGSYASSYIDMIDRIAPVAPKANNITTEDTSIKGTAEADTNINLTFSDGRTLNGKVDTNGNFSITIPSDYVLTGKETIKITSIDKGDNVSPAITISVIDKTPPAVKAISNKTQEVNTAFNPFIIEATDNSGDKVMHDVRGLPAGVTFNNSSNMISGTPTDVGSYTVTVISRDVKGNETETSFKINVVDTTKPTVESVADQTQEVNTEITPITIESEDNSGQAVTNKVEGLPDGVTFDEATNTISGTPSEVGRYDITVTTIDESGNATETTFTIDVKDTTKPTVESIANQTQEVN

SEQ ID NO: 42420 - protein, 995 aa, Staphylococcus epidermidis NIHLM031
MKKRRQGPINKRVDFLSNKVNKYSIRKFTVGTASILVGATLMFGAADNEAKAAEDNQLESASKEEQKGNRDNENSKLNQVDLDNGSHSSEETTNVNNATEVKKVEAPTTSDVSKPKTNETVVTNESTKPKKAEAPTVNEESITETPKTSTTQQDSTEKNNPSLKDNLNSSSTTSKESKTDEHSTKQAQMSTNKSNLDTNDSPTQSEKTSPQANNDSTDNQSAPSKQLDSKPSEQKVYKTKFNDEPTQEVENTTTKLKTPSISTDSSVNDKQDYTRSAVASLGVDSSETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSNDGSIVANGVYDKATNTTTYTFTNYVDQYQNITGSFDLIATPKRETAIKDNQSYPMEVTIANEVVKKDFIVDYGNKKDNTTTAAVANVDNANNKHNEVVYLNQNNQNPKYAKYFSTVKNGKFIPGEVKVYEVTDTNAMVDSFNPDLNSSNVKDVTSQFAPKVSADGTRVDINFASSMANGKKYIVTQAVRPTGTGNVYTEYWLTRDGTTNTNDFYRGTKSTTVSYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGQRDGTRKVVVAKGTINNADNMTVDTGFYLTPKYNVGDYVWEDTNKDGIQDDNEKGISNVKVTLKDKNGNTIGTTTTDSNGKYEFTGLENGDYTIEFETPEGYTPTKQNSGSDEGRDSNGTKTTVTVKDADNKTIDSGFYKPTYNLGDYVWEDTNKDGIQDDNEKGISNVKVTLKDKNGNAIGTTTTDASGHYQFKGLENGSYTVEFETPSGYTPTKANSGQDITVDSNG

SEQ ID NO: 42421 - protein, 25 aa, Staphylococcus epidermidis NIHLM031
MAADIISTIGDLVKWIIDTVNKFKK

SEQ ID NO: 42422 - protein, 688 aa, Staphylococcus epidermidis NIHLM031
MKTRQNKYSIRKFSVGASSILIAALLFMGGGSAQAAEQQQDKGTVENSTTQSIGDENEKLSEQQSTQNKNVNEKSNVNFITENENLHNETPKNEDLIQQQKDSQNDNKSESVVEQNKKNEAFVQNHSEEKPQQEQVELEKHASENNQTLHSNAAQSNEDVKTKPSQLDNATAQQKDSQKENLSKQDTQSSKNTDLLRATGQNQSKDSQSTEEVNKEVNNDTQQVTAKKDDDKVETFNLNSKEEPLKVDKQANPTTDKDKSSKNDKGSQDGLANLESNAVATTNKQSKQQVSEKNEDQTNKSAKQKQYKNNDPIILVHGFNGFTDNINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLVYDVGKMYGNKDSRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42423 - protein, 728 aa, Staphylococcus epidermidis NIHLM031
MKNKKNSYSIRKLSVGASSIIVTSMLFIGGGSVHAAESNQLENQEQSEVSASHSIELQHKDQEIQQPENKDNKNYHSETIDKNPTIHNNDYSYHETPSTDVKSNESKQIDNQSNQPQTSMTKNDQQNPKKVAEHTTKGINAKKEETRKNENAKSLVQPQQDDKTTSEQTKMKESREQDITNEQKQLQSKDVKNVQQENQNIDQEKSQEKINLQQSSIEKAQKSSRIDGKLDHQYNKDATQSNEDTASENVSEQHITAKDEGVTRNNRGDERLNQEKSTTSSDKELKVDDIDKDLSTKESPENEKDDSRKGIKALTKNSQATTRNTATTEASKELKDQTNKVASQKEYKNHDPIILVHGFNGYASGTGPITGKGNYWGGDRLKIIQDYRAKGYNVMEASVSAFGSNYDRAVELYYYIKGGRVDYGAAHAAKYGHERYGKTYAGAYKDWKPGQKNHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42424 - protein, 1334 aa, Staphylococcus epidermidis NIHLM031
MGNKQGFLPNKLNKYSIRKFTVGTASLLVGATLVFGIGSEAQAAELDTITKEDVKSQDKGEALDIKNIKESEKDVTTEDDNNAQVQNSAQTVDKSENSNDTAVESTNDSVKTDETKETSENKSAQDDDNIKEDSNTQEESTNTSLQSSEVPQTKKDTNETSETAIDEDVSTKEQNNKDNDTAQDDDNIKEDSNTQEESTNTSPQYSEYSQTKKEQPDKSSNSIKEPDKQQEEVAKEEKATTEIADKNKELELKNNKTDKNEESELESNLSSSENKKDTVESFLNSQLSDSETKKIMENANIDYDKATDEEINTEILRASLIEMANKKKKTETLATPQRTMFRAMATPTALRAAVNQDEELQKSLGYTDNYTFASMLFDPGKLDSDDALNSNIIPFDLHSYMSGSNSGNRYKIDLKLDPIIAEHVTKISANPSGSNKPVEFVRIKDENGNLTDTWEVNFIRANDGLFGGAEILSQYTAKNGKIELDDTVGNIVSNAGNLSNNKLNYQVFVRDSKENKIVRTSESSGYFLTKADNDLVNLKNNVSTENNNAFKASSGSATYNKDVGEFGGILIDQQIMKNGIFSYSKTKANQWSYNYQIDKDLLPYIEGVELHQYDYKGLEGFDKNYDAKNKVADLTIDEVGNGTITSDNLNKLIEFNNALPETVGVRVVLKLNQSVNNILTKDAKYDSEGNLIRETTKQKEDFTFAGYLTDSKGALINNTLGTSTLALQDYDKDGLLDRYERQVSLSDAESEDTDGDGKNDGDEVINYKTSPLVGKPQAADITTEDTVVSGSVPLKEGAATQTAKVINAEGTTVGTTTVNSDGTFSVSIPNSPEGTYTIAIDSPNYDNDEVNTFEIVDNSKLPAPSINPVDDNDQQIVVNGTSGSTVTVTDSNNNVLGTVTIPADDTSAAINVDTPLEAGTVLTSTASKDGKTSDVSDQITVTDATAPDAPTLDEVNTDATQVTGQAEPGSTVTVAFPGGGKASTTADDAGNFIVDIPSEVNLEGGETFTATATDETGNESEPSTTTVVDTTAPDAPTVNDVTSNDKVINGTAEPNSTVKLTFPDGTTAAGTTDSNGNYTVDIPENMSLKGGETISATSSDAEGNESESATTTVVDATAPDAPTINEVDTNATEVNGTAEPNSTVTVTFPDGTTATGTADDQGNYTIEIPSNVDLRNGNKIEAVSADEAGNVSGPGTTTVAGEDTATAPTINNVTSDDTRITGTADAGNTVTITFPDGTTATGTADDQGNYTIDVPSNVDLNGGEEIQVKATDNRGRDSVTVTTTATDVTAPDAPVVNGVSSDATQVTGQAEPGSTVTVTFPDGTTATGTTDDEG

SEQ ID NO: 42425 - protein, 434 aa, Staphylococcus epidermidis NIHLM031; identical to SEQ ID NO: 39380

SEQ ID NO: 42426 - protein, 291 aa, Staphylococcus epidermidis NIHLM031
MKKIDSWLTKHGLKNRLTLVVIAIFIIFLILLFMFVNLSDEDTGQITITENAELRTGPNAAYPVIYKIDKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKTLLTNRGSRQQNYQVLRQTDIPAVLLELGYISNPTDESMINDQLHRQVVEQAIVDGLKQYFSS

SEQ ID NO: 42427 - protein, 129 aa, Staphylococcus epidermidis NIHLM037
MGKRRQGPINKKVDFLQNKLNKYSIRKFTIGTASILVGATIFFGSADHEAKAAEENQVESITQINEKAETENDVETSKPETAKAETENDVETSKPEAAKAETENDVETSKPEAAKAETENDVETSKPEA

SEQ ID NO: 42428 - protein, 25 aa, Staphylococcus epidermidis NIHLM037
MAADIISTIGDLVKWIIDTVNKFKK

SEQ ID NO: 42429 - protein, 327 aa, Staphylococcus epidermidis NIHLM037
MNWQRKCILTTLLVLSSLFLVFSTITYASERDYKDSLKITTHNVYFLPTAIYPNWGQSQRADLISKADYIQNQDVVILNESFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42430 - protein, 728 aa, Staphylococcus epidermidis NIHLM037; identical to SEQ ID NO: 42333

SEQ ID NO: 42431 - protein, 251 aa, Staphylococcus epidermidis NIHLM037
DEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGTPAEPGKPAEPGTPAEPGKPAEPGTPAEPGTPAEPGTPAEPGTPAQSGAPEQPNRSMHSTDNKNQLPDTGENSQANEGTLVGSLLAIVGSLFIFGRRKKGNEK

SEQ ID NO: 42432 - protein, 3692 aa, Staphylococcus epidermidis NIHLM037
MNLFRKQKFSIRKFNIGIFSALIATVAFLAHPGQATASELEPFQNNDTTAQSDGGLENTSQSNPISEETTNTLSEQTVPSSTENKQTQNDPHHNAQPIAINAEEAESAQTAPYTNIYENNDTSDNGLHVNQPVKHHIEAQSEDVTNHTNSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDTGDPKNSQAIENVVALGRIHGNDVNDHGDFNGIEKEFNVNPNSELIFSFNTMTARNYKGGTNLVLRNAENNQEIATADVQGGGIYRLFKLPDNVYRIKVQFLPNNELMRDARRIYQLQDGYKYYSFIDTVGINSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLSRSSQDVARFLPNKVLNIRYKLRPVNISTPREVTFNEAIKYKTFSEYYINTTDNTVTGQQTPFSINVIMNKDDLSEQVNKDIIPSNYTLASYNKYNKLKERAQNVLDEETNNTPFNQRYSQTQIDDLLHELQTTLISRVSASREINDKAQEMTDGVYDSAELTTEEKDTLVDQIENHKNEISNNIDDELTDDGVERVKEAGLHTLESDTPHPVTKPNARQVVNNKAEQQKTLIRNNHEATTEEQNEAISQVEAHSSDAIAKIGEAETDTTVNEARDNGTKLIATDVPNPTKKAEAREAVTNSANSKIKDINNNTQATLDERNDAITLVNRSKDEAIQNINTAQGNDDVTEAQNNGTNTIQQVPLTPVKRQNAIATINAKADEQKRLIQANNNATTEEKADAERKVNEALLTATQNISNAPTNRDVDQAQTTGSGIISTISPATKIKEDARAAVEAKAIAQNQQINSNNMATTEEKQDALNQVEAHKQATITNINQAQSTQQVSEARNNGINTINQDQPNAVKKNNTKTLLEQKGNEKKSAIAQTPDATIEEKQEAVSVVSQAVTNGNNHINQANSNDDVDQALSNAEQIITHTDVNVQKKPQARQALIAKVNEKQSAINTDNEGTIEEKQKAIQSLNDVKNSADEQITQAASNQNVDNALNIGISNISKIQTNFTKKQQARDQVNQKFQEKEAELNSTPHATHDEKQDALTRLTQVKESILNDINQAQTNQNVDTALTNGIQNIQNIQVDVRKKQEARTTINDIVQQHKQTIQNNDDATTEEKEVANNLVNVSQQNVISKIDNATTNNQIDGIVSDGRQTINAITPDTSIKRNAKNDIDGKAADRKIKIQRINDATAEEIQEANRKIEEAKIEAKDNIQHSSTRDQVNEAKTNGINKIENITPATTVKSEARQAVQNKANEQINHIQNTPDATNEEKQEAINRVSAELARVQAQINAEHTTQGVKNIKDDAITSLSRINAQVVEKESARNAIEQKSTQQTQFINDNDNATDEEKEVANNLVIARKQNALDNINSLSSNSDIEIAKVTGINEIAKVLPATSVKSKAKKDIDQKLAQQINQIQTHQTTIIEEKEAAIQLANQKANEARTAIQNEHSNNGVAQAKSNGIHEIELVTPDAHKKSDAKQSIDDKYNEQSNTINTTPDATDEEKQKALDKLKIAKDAGYNKVDQAQTNQQVSDAKTEAIDTITNIQANVAKKPSARMELDSKFEDLKRQINATPNATEEEKQDAIQRLNVKREEVKNLINQDRRDNDVEQHKNTGLQELETIHANPTRKSDALQELQTKFISQTELINNNKDATNEEKAEAKRLLEISKNKTITNINQAQTNNQVDNAKDNGMNEIATIIPATTIKTDAKTAIDKKAEQQVTIINGNNDATDEEKAEARKLVEKAKTEVKSNITNSDTEREVNSAKTNGLEKINNIQPSTQTKTNAKQEINDKAQEQLIQINNTPDATEEEKQEATNRVNAGLAQAIQNINNAHSTQEVNESKTHSIATIKSILPNVIKKPTAINDLTQEANNQKTLIGNDGNATDDEKEAAKQLVTQKLNEEIQKIHESTQDNQVDNVKAQAITAIKLINANAHKRQDAINILTNLAESKKSDIRANQDATTEEKNTAIQSIDDTLAQARNNINGANTNVLVDENLEDGKQKLQRIELSTQTKTQAKADIAQAIGQQRSTIDQNQNATTEEKQEALERLNQDTNGVNDRIQAALANQNVTDEKNNILETIRNVEPIVVVKPKANENIRKKAAEQTTLINQNQDATLEEKQIALGKLEEVKNEALNQVSQAHSNNDVKIAENNGIAKISEVHPETSIKRNAKQEIEQVAQSQIDTINANNKSTNEEKSAAIDRVNVAKIDAINNIANATTTQLVNDAKNNGNTSITQILPSTAVKTNALAALATEAKNKNAIIDQTPNATAEEKEEANNKVDGLQEEADANILKAHTTEEVNNIKNQAVQNINAVQVEVIKKQNVKNQLNQFVDNQKKIIENTPDATLEEKAEANRLLQNVLTSASDEIANVVHNNEVDQALDKARPKIEAIVPQVSKKRDALNAIQEAFNSQTQEIQENQEATNEEKTEALNKINQLLNQAKVNIDQAQSNKDVDNAKTRIIQDIEQIQAHPQTKETGRHRLNEKANQQQSTIATHPNSTIEERQEASAKLQEVLKKAIAKIDKGQTNDDVEKTVVNGIAEIENILPTTTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATDDEVREGLNQLNQIHEKAKNDVNQSQTNQQVENAEQNSLDLINNFRPDFSKKRNAVAEIVKAQQNKIDEIEQEFSATQEEKDNALQHLDEQVKEIINSINRANTDNEVDNAKTSGLNNINEYRPEYNKKKNAILKLYDVSDTHEAIINGYPDATEDELQEANSKLNKILLDAKKQIGLAHTNNEVDDIYNEVSQKMKTILPRVDTKAVARSVLNALAKQLIKTFENTPDVTHEERNDAINHVKEQLSLVFNAIEKDQKDIQVAQDELFGLNELNSIFINITQKPTARKAISDKASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNQSFITINNVNKNQEVYDTKNKTIEAIHKIKPITIIKPQALNEITNQLDAQRDLIKNNNESTVEEKASAIDKLIKTAARIAEAIDKAQTNEDVKNIKKQSIDEISKILPVIEIKLAARNEIHQKAEVIRGLINNNEEATKEEKDVALNQLDTTLTQANLSIDQALTNEAVNRAKEIATSEINKISVITIKKPEAIAEIQELADKKLNKFKQNQEATIEENQSAINELEQALKSAINHIHQSQNNESVSAALKESISLIDSIEIQAHKKLEAKAYIDGYSDDKINDISSRATNEEKQIFVSKLKALINHAHKQIDEAETFVSVDTIVRNFKVEVDKLNSIVRKKAKALKEIELEADHVKQMINANLSASTRVKQNARTLINEIVSNALSQLNKVTTNKEVDELVNETIEKLKSIQLREDKILSSQRSTTSMTEKSNQCYSSENNTIKSLPETGNVDKSVPLAGVTLISGLAIMSSRKKKKDKKVND

SEQ ID NO: 42433 - protein, 609 aa, Staphylococcus epidermidis NIHLM037
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTLPADQENNAPQAGAGTPGAENTPQAGGENHNQDNAVTAAGTSGEQNGGKPATSTTGQDAAQPNGPQGTSVAQPSNDASSQGHDTPQADAGTHNTEGQPAVTTGEQAGGKPAATKPEGADTETAPVPNTADENHAQPSPQSGGTTATQAGQVKPSGDSTPTGKPNTADDQGTQIKPTSNQGTTATTGETGNQKPSGQTGNTENTPNNGTQVKPNNNPAVTGTPNANEEQTGQPNATVTPGQGNDEINGATKPGEVSPKPEENNPAVTEPGTTAPGNTNQGTQVKPNPDQNNNPTTGQDTDQTDQGTQVKPNNDQTATGTQGATGDQNTQQGNTEQNNQNAEQGNTGQEGSNPNQSAQLGATVKPGSAPTQDTEVKPNPDQNNNPTTGQDADQTGQGTQVKPNNNQTATGTQGATGDQNTQQGNAGNKGNAGNKGNAGNKGNTGNADKDAKVNTNDDETKTDVKNGTELPETGLSNEYDYTTTVFGSIALISSLLLLRRQRKESK

SEQ ID NO: 42434 - protein, 188 aa, Staphylococcus epidermidis NIHLM037
TEEIPFDKKREFNPDLKPGEERVKQKGEPGTKTITTPTTKNPLTGEKVGEGEPTEEITKQPVDEIIEYGPTPDKPGNPDQPTPDEPGNPDQPTPDEPGNPDQPTPDEPGNPDQPTPDEPGNPDQPTPDEPGNPDQSKNVNHSTINKDHLPDTGDNSKSNQGILAGSLLSILGSLFIFGRRKNKDNSEK

SEQ ID NO: 42435 - protein, 190 aa, Staphylococcus epidermidis NIHLM037; identical to SEQ ID NO: 39373

SEQ ID NO: 42436 - protein, 156 aa, Staphylococcus epidermidis NIHLM037
SDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 42437 - protein, 884 aa, Staphylococcus epidermidis NIHLM037
MINKKNNLLTKKKPIANKSNKYAIRKFTVGTASIVIGATLLFGLGHNEAKAEENTVQDVKDSNTDDELSDSNDQSSNEEKNDVINNSQSINTDDDNQINKKEETNSNDAIENRSKDITQSTTNVDENEATFLQKTPQDNTQLKEEVVKEPSSVESSNSSMDTAQQPSHTTINSEASIQTSDNEENSRVSDFANSKIKEINTESDKEENTIEQPNKVREDSTTSQPSSYRNIDEKISNQDELLNLPINEYENKARPLSTTSAQSPIKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYNEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGIPGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSD

SEQ ID NO: 42438 - protein, 219 aa, Staphylococcus epidermidis NIHLM037
MKKTLVASSLAIGLGVVAGNAGHDAHASETTNVDKAELAQKALTNDQSLNESPVQEGAYNINFDYNGNSYHFESDGSTWSWSYESTNNATQPVQPSQSQVATQQQPVQVSAPQNEQTAQPQTKSTSASQTSSSKASSGSSVNVNSHLQQIAQRESGGGIHAINPSSGAAGKYQFLQSTWDSVAPSQYKGVSPAKAPESVQDKAAVKLYNTGGPGHWVTA

SEQ ID NO: 42439 - protein, 190 aa, Staphylococcus epidermidis NIHLM037; identical to SEQ ID NO: 42345

SEQ ID NO: 42440 - protein, 681 aa, Staphylococcus epidermidis NIHLM037
MKNNNRIKRFSIRKYAVGVVSIITGVTIFIGGQQAQAAEISVQHADAHPEDSQTTQQLKNDKVEETLKASKQGTADSQQVQRIDQSKTNQNNQHSVAESAQLKSDETANQPKVEEESSVKQDVQPSKNVNQQDVATQSNERENNDIKGESQTSKASNQHTQSSNSHNQSIGTKDSDSEELDQPLVKLQKPSNDSTYQTQSKAKQDSSKQLPQEKTTKYQIQTTENEQTTNVDSKKANDTQDARQHTQEPKNDTSTSQKNHHQVATKEQSNRSTTRETQKQSANSNQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42441 - protein, 688 aa, Staphylococcus epidermidis NIHLM037
MKTRQNKYSIRKFSVGASSILIAALLFMGGGSAQAAEQQQDKGTVENSTTQSIGDKNEKLSEQQSTQNKNVNEKSNVNSITENENLHNETPKNEDLIQQQKDSQNDNKSESVVEQNKKNEAFVQNHSEEKPQQEQVELEKHASENNQTLHSNAAQSNEDVKTKPSQLDNTTAQQEDSQKESLSKQDTQSSKNTDLLRTTGQNQSKDSQSTEEVNKEVNNDTQQVTAKKDDDKVETFNLNSKEEPLKVDKQANPTTDKDKSSKNDKGSQDGLANLESNAVATTNKQSKQQVSEKNEDQTNKSAKQKQYKNNDPIILVHGFNGFTDNINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLVYDVGKMYGNKDSRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42442 - protein, 235 aa, Staphylococcus epidermidis NIHLM037
MKKTVIASTLAVSLGIAGYGLSGHEAHASETTNVDKAHLVDLAQHNPEELNAKPVQAGAYDIHFVDNGYQYNFTSNGSEWSWSYTVAGSDADYTESSSNQEVSANTQSSNTNVQAISAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKAYKAQGLSAWGM

SEQ ID NO: 42443 - protein, 291 aa, Staphylococcus epidermidis NIHLM037; identical to SEQ ID NO: 42332

SEQ ID NO: 42444 - protein, 434 aa, Staphylococcus epidermidis NIHLM037
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSSAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 42445 - protein, 129 aa, Staphylococcus epidermidis NIHLM039
TPDQPGNPDQPTPDEPGNPDQPTPDEPGNPDQPTPDQPGNPDQPTPDEPGNPDQPTPDQPGNPDQPTPDQPGNPDQSKNVNHSTINKDHLPDTGDNSKSNQGILAGSLLSILGSLFIFGRRKNKDNSEK

SEQ ID NO: 42446 - protein, 728 aa, Staphylococcus epidermidis NIHLM039
MKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQFNQPQTSMPNNDQQNPKKVAEHTTKSINAKKEETRKNENAKSLVQPQQDDKTTSEQTKMKESREQEITNEQKQIQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKAITKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42447 - protein, 1098 aa, Staphylococcus epidermidis NIHLM039
MINKKNNLLTKKKPIANKSNKYAIRKFTVGTASIVIGATLLFGLGHNEAKAEENSVQDVKDSNTDDELSDSNDQSSDEEKNDVINNNQSINTDDNNQIIKKEETNNYDGIEKRSEDRTESTTNVDENEATFLQKTPQDNTHLTEEEVKESSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDNDSDLGNSSDKSTKDKLPDTGANEDYGSKGTLLGTLFAGLGALLLGKRRKNRKNKN

SEQ ID NO: 42448 - protein, 291 aa, Staphylococcus epidermidis NIHLM039; identical to SEQ ID NO: 41987

SEQ ID NO: 42449 - protein, 219 aa, Staphylococcus epidermidis NIHLM039; identical to SEQ ID NO: 39379

SEQ ID NO: 42450 - protein, 327 aa, Staphylococcus epidermidis NIHLM039; identical to SEQ ID NO: 42020

SEQ ID NO: 42451 - protein, 235 aa, Staphylococcus epidermidis NIHLM039
MKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNDQINAAYKTYKAQGLSAWGM

SEQ ID NO: 42452 - protein, 123 aa, Staphylococcus epidermidis NIHLM039
MKKKLDFLPNKLNKYSIRRFTVGTASILVGSTLLFGIGNEAHAAEKNQESNTTANVADSDVGEAPSKEEAPSNEATNEAPSKEEAPSNEATNEAPSKEEAPSNEATNEAPSKEEAPSNEATNE

SEQ ID NO: 42453 - protein, 681 aa, Staphylococcus epidermidis NIHLM039; identical to SEQ ID NO: 41996

SEQ ID NO: 42454 - protein, 244 aa, Staphylococcus epidermidis NIHLM039
SESHSDSESDSDSESTSESDSESHSDSESDSDSESTSESDSESHSDSESDSDSESTSESDSESHSDSESDSDSESTSESDSESHSDSESDSDSESTSESDSESHSDSESDSDSESTSESGSESHSDSESDSDSESTSESDSESHSDSESDSDSESTSESDSESHSDSESHSDSESTSESDSESHSDSESDSDSESTSESGSESHSNSELPDTGEEDNHQGLIGGVLAAFGGLTLLGRRRKKEEK

SEQ ID NO: 42455 - protein, 152 aa, Staphylococcus epidermidis NIHLM039
MGKRRQGPINKKVDFLQNKLNKYSIRKFTIGTASILVGATMFFGSADHEAKAAEENQVESITQINEKAETENDVETSKPEAAKAETENDVETSKPEAAKAETENDVETSKPEAAKAETENDVETSKPEAAKAETENDVETSKPEAAKAETEN

SEQ ID NO: 42456 - protein, 691 aa, Staphylococcus epidermidis NIHLM039
MKTRQNKYSIRKFSVGASSILIAALLFMGGGSAQAAEQQEQQQDKGTVENSTTQSIGDGNEKLSEQQSTQNKNVNEKSNVNSITENESLHNETPKNEDWIQQQKDSQNDNKSESVVEQNKENEAFVQNHSEEKPQQEQVELEKHASENNQTLHSKAAQSNEDVKTKPSQLDNTAAKQEDSQKENLSKQDTQSSKTTDLLRATAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 42457 - protein, 434 aa, Staphylococcus epidermidis NIHLM039; identical to SEQ ID NO: 39380

SEQ ID NO: 42458 - protein, 814 aa, Staphylococcus epidermidis NIHLM039
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQGTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTNQAGATVKPGTTPNQDAEVKPNTDQTATGTQGATGDQNAEQGNTEQNNQNAEQGNTEQNNQNAEQGNTGQEGSNPNQSGQLGATVKPGSAPNQDTEVKPNPDQNNNPTTGQYANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDQTNQSTQDDNDNQNTQQGNTKQNNQNAEQGNTGGTDKDAKVNTNDDETKTDVKNDTELPETGLSNEYDYTTTVFGSIALISSLLLLRRQRKESK

SEQ ID NO: 42459 - protein, 3692 aa, Staphylococcus epidermidis NIHLM039
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEKVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTSHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDAIDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEKKEVANNLVIATKQKSLDNINSLSSNNDVENAKVEGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKGIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42460 - protein, 25 aa, Staphylococcus epidermidis NIHLM039
MAADIISTIGDLVKWIIDTVNKFKK

SEQ ID NO: 42461 - protein, 219 aa, Staphylococcus epidermidis NIHLM040; identical to SEQ ID NO: 42051

SEQ ID NO: 42462 - protein, 434 aa, Staphylococcus epidermidis NIHLM040; identical to SEQ ID NO: 39380

SEQ ID NO: 42463 - protein, 25 aa, Staphylococcus epidermidis NIHLM040
MAADIISTIGDLVKWIIDTVNKFKK

SEQ ID NO: 42464 - protein, 681 aa, Staphylococcus epidermidis NIHLM040
MTNNNRIKRFSIRKYAVGVVSIITGVTIFIGGQQAQAAETSVQHADAHPEDSQTTQQLKNDKVEETLKASKQGTADSQQVQTIDQSKTNQNNQHSVAESAQLKSDETANQAKEEEGSSVKQDVQPSKNVNQQDVATQSNERENNDIKGEAQTSKASNQHTQSSNSHNQSTGTKDSDSEEIDQPLVKVQKPSNDSTYQTQSKEKQDSSKQLPQEKTTKRQIQTTENEQTTKVDSKKANDTQDVEQHTQKPKNDTSTSQKNHHQVATKEQSNRSTTRETQKQSANANQNHQSTHQVQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKEMINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42465 - protein, 130 aa, Staphylococcus epidermidis NIHLM040
MKKKLDFLPNKLNKYSIRRFTVGTASILVGSTLLFGIGNEAHAAEKNQESNTTANVADSDVGEAPSKEEAPSNEATNEAPSKEEAPSNEATNEAPSKEEAPSNEATNEAPSKEEAPSNEATNEAPIKRRS

SEQ ID NO: 42466 - protein, 146 aa, Staphylococcus epidermidis NIHLM040
SDSDADSDSDSDSDSDADSDSDSDSDSDSDSDSDSDSDADSDSDSDSDSDADSDSDSDSDSDADSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 42467 - protein, 134 aa, Staphylococcus epidermidis NIHLM040
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAE

SEQ ID NO: 42468 - protein, 327 aa, Staphylococcus epidermidis NIHLM040; identical to SEQ ID NO: 42020

SEQ ID NO: 42469 - protein, 80 aa, Staphylococcus epidermidis NIHLM040
VRQAEPGKPAESGKPVEPGTPAQSGAPEQPNRSMHSTDNKNQLPDTGENRQANEGTLVGSLLAIVGSLFIFGRRKKGNEK

SEQ ID NO: 42470 - protein, 1028 aa, Staphylococcus epidermidis NIHLM040
MINKKNNLLTKKKPIANKSNKYAIRKFTVGTASIVIGATLLFGLGHNEAKAEENSVQDVKDSNTDDEISDSNDQSSDEEKNDVINNNQSINTDDNNQINKKEETNSNDGIEKRSEDRTESTTNVDENEATFLQKTPQDNTHLTEEEVKEPSSVESSNSSIDTAQQPSRTTINRESSIQASDNVEDSHVSDFANSKINESNAESGKEETTIEQPNKVREDSTTSQPSSYKNIDEKISNQDELLNLPKNEYENKARPLSTTSAQPSIKRVTVNQLAAEQGSNVNHLIKVTDQSITEGYDDSDGIIKAHDAENLIYDVTFEVDDKVKSGDTMTVNIDKNTVPSDLTDSFTIPKIKDNSGEIIATGTYDNKNKQITYTFTDYVDKYENIKAHLKLTSYIDKSKVPNNNTKLDLEYKTALSSVNKTITVEYQKPNENQTANLQSMFTNIDTKNHTVEQTIYINPLRYSAKETNVNISGNGDEGSTIIDDSTIIKVYKVGDNQNLPDSNRIYDYSKYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDLGSDSDSDSDSDSDSDSDLGNSSDKSIKDKLPDTGANEDYDSKGTLLGTLFAGLGALLLGKRRKNRKNKN

SEQ ID NO: 42471 - protein, 974 aa, Staphylococcus epidermidis NIHLM040
MNNRDKLQKFSIRKYAIGTFSTVIATLVFMGINTNHASADELNQNQKLIKQLNQTNDDSNTHSQEIENNKQNSGGQTEPLRSSTSQNQANAQPSDQIKDTNETSQQLPTNVSDDSINQSHSEANMNNEPLKVDNSTMQAHSKIVSDSDGNASENEHHKLTENVLAESRASKNDKEKENLQEKDKSQQVQPPLDKNALQAFFDASYHNYRMIDRDRADATEYQKVKSAFDYVNDLLGNNQNVPSEQLVSAYQQLEKALELARTLPQRSTTEKRGRRSTRSVVENRSSRSDYLDARTEYYVSKDDDDSGFPPGTFFHASNRRWPYNLPRSRNILRASDVQDNAYITTKRLKDGYQWDILFNSNHKGHEYMYYWFGLPSDQTPTGSVTFTIINRDGSSTSTGGVGFGSGAPLPQFWRSAGAINSSVANDFKHGSATNYAFYDGVNNFSDFARGGELYFDREGATQTNKYYGDENFAMLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSEGSGSNDSVYDPLSYVKNVNGTVLGIYPSYLPYNQERWQGANAMNAYQIEELFSQENLQNAARSGRPIQFLVGFDVEDGHHKPETLLPVNLYVKPELKHTIELYHDNEKQDRKEFSVSKRAGHGVFQVMSGTLHNTVRSGILPYQQEIRIKLTSNEPIKDSEWSITRYPNTLTLQNAVGRTNNATEKNLALVGHIDPGNYFITVKFGDKVEQFEIRSKPTPPRIITTANELRGNPNHKPEIRVTDIPNDTSAKIKLVMGGTDGDHDPEINPYTVPENYTVVAEAYHDNDPSKNGVLTFRSSDYLKDLPLSGELKAIVYYNQYVQSNFSNSVPFSSDTTPPTINEPAGLVHKYYRGDHVEITLPVTDNAGGSGLRDVNVNLPQGWTKTFTINPK

SEQ ID NO: 42472 - protein, 147 aa, Staphylococcus epidermidis NIHLM040
DSESHSDSESTSESDSESHSDSESTSESDSESHSDSESTSESDSESHSDSESDSDSESTSESDSESHSDSESHSDSESTSESDSESHSDSESDSDSESTSESGSESHSNSELPDTGEEDNHQGLIGGVLAAFGGLTLLGRRRKKEEK

SEQ ID NO: 42473 - protein, 737 aa, Staphylococcus epidermidis NIHLM040
MKKSSKFSKDFPTRKNHYAIRKFTVGTASIIVGSFLFFGQTQAHAEEFERVTTGTVDTGGQPARANQGQEGPQAGADTHNTASQPGVTGQDAPNENHAGDQNAAVTHPADQENNAPQVGAGTPGAENTPQAGGENHNQENAVTSAGTNGEQNSGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTSTGEPNKADDQGTQIKPTSNQGTTATTDETGNQKPSGQTGNTENTPNEGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPGTTPNQDAEVKPNPDQNNNPTTDQNADQTGQGTQVKPNTDQTATGTQGATGDQNAEQGNTEQNNQNTEQGNTGQEGSNPNQSSQLGATVKPGSAPNQDTEVKPNPDQNNNPTTGQDAKQTGQDTQVKPNNDQTTTGTDNQNTQQGNTEQNNQNAEQGNTGQEGSNPNQSGQLGATVKPGSAPNQDTEATPKPDQNNTPTTGHEGNQTGQGTQVKSNNDQTTTGTQTSTNNQNTQQGNTGDTDKDAKVNTNDDETKTDVKNDTELPETGLSNEYDYTTTVFGSIALISSLLLLRRQRKESK

SEQ ID NO: 42474 - protein, 688 aa, Staphylococcus epidermidis NIHLM040; identical to SEQ ID NO: 41929

SEQ ID NO: 42475 - protein, 291 aa, Staphylococcus epidermidis NIHLM040
MKKIDSWLTKHGLKNRLTLVVIVIFIIFLILLFMFVNLSDEDTGQITITENAELRTGPNAAYPVIYKIEKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSY

SEQ ID NO: 42476 - protein, 235 aa, Staphylococcus epidermidis NIHLM040
MKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGNTAGSVGSYAAAQMAARTGVSASTWEHIIARESNGQLHARNASGAAGLFQTMPGWGSTGSVNNQINAAYKAYKAQGLSAWGM

SEQ ID NO: 42477 - protein, 814 aa, Staphylococcus epidermidis NIHLM049; identical to SEQ ID NO: 42202

SEQ ID NO: 42478 - protein, 291 aa, Staphylococcus epidermidis NIHLM049; identical to SEQ ID NO: 39372

SEQ ID NO: 42479 - protein, 434 aa, Staphylococcus epidermidis NIHLM049; identical to SEQ ID NO: 39380

SEQ ID NO: 42480 - protein, 235 aa, Staphylococcus epidermidis NIHLM049; identical to SEQ ID NO: 41955

SEQ ID NO: 42481 - protein, 681 aa, Staphylococcus epidermidis NIHLM049
MTNNNRIKRFSIRKYAVGVVSIITGVTIFIGGQQAQAAETSVQHADAHPEDSQTTQQLKNDKVEETLKASKQGNADSQQVQTIDQSKTNQNNQHSVAESAQLKSDETANQPKKEESSSVKQDVQPSKNVNQQDAATQSNERENNDIKGEGQTSKTSNQHIQSSNSHNQSTGTKDSDSEEIDQPLVKLQKPSNDSTYQTQSKTKQDSSKQLPQEKTTKRQIQTTENEQTTKVDSKKANDTQNVEKHTQEPKNDTSTSQKNHHQVATKEQSNRSTTRKTQKQSSNANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDVNKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42482 - protein, 892 aa, Staphylococcus epidermidis NIHLM049; identical to SEQ ID NO: 41992

SEQ ID NO: 42483 - protein, 25 aa, Staphylococcus epidermidis NIHLM049
MAADIISTIGDLVKWIIDTVNKFKK

SEQ ID NO: 42484 - protein, 327 aa, Staphylococcus epidermidis NIHLM049; identical to SEQ ID NO: 42156

SEQ ID NO: 42485 - protein, 138 aa, Staphylococcus epidermidis NIHLM049
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQS

SEQ ID NO: 42486 - protein, 728 aa, Staphylococcus epidermidis NIHLM049; identical to SEQ ID NO: 42297

SEQ ID NO: 42487 - protein, 688 aa, Staphylococcus epidermidis NIHLM049; identical to SEQ ID NO: 41929

SEQ ID NO: 42488 - protein, 3692 aa, Staphylococcus epidermidis NIHLM049
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQSIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKTNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42489 - protein, 219 aa, Staphylococcus epidermidis NIHLM049; identical to SEQ ID NO: 39379

SEQ ID NO: 42490 - protein, 636 aa, Staphylococcus epidermidis NIHLM053
MKKSSKFSKDFPTRKNHYAIRKFTVGTASIIVGSFLFFGQTQAHAEEFERVTTGTVDTGGQPARADQGQEGPQAGANTHNTASQPAATGQDAPNENHAGDQNAAVTHPADQENNAPQAGVGTPGAENTPQAGGENHNQDNAVTAAGTSGEQNGGKPATSTTGQEAAQPNGPQGTSVAQPGNDASSQGHDTPQADAGTHNTEGQPAVTTGEQASGKPAATKPEGAGTETAPAPNTADESHAQPSPQSGGTTATQAGQVKPSGDSTPTGKPNTADDQGTQIKPTSNQGTTVTTGETGNQKPSGQTGNTENTPNDGTQVKPNNDPAATGTPNANEEQTGQPNATVTPGQGNDEINGATKPGEVSPKPEENNPAVTEPGTTAPGNTNQGTQVKPNPDQNNNPTTGQDADQTGQGTQVKPNNNQTATGTQGATGDQNTQQGNTEQNNQNAEQGNTGQEGSNPNQNAQLGATVKPGSAPNQDAEVKPNPDQNNKPTTGQDADQTGQSTHVKPNNNQTATGTQDANGDQNMQQGNAGNAGNAGNTGNAGNTGNAGNAGNAGNAGNAGNAGNTGNTGNAGNKGNTDKDAKVNTNDDETKADVKNSTELPETGLSNEYDYTTTVFGSIALISSLLLLRRQRKESK

SEQ ID NO: 42491 - protein, 681 aa, Staphylococcus epidermidis NIHLM053
MKNNNRIKRFSIRKYAVGVVSIITGVTIFIGGQQAQAAEISVQHADAHPEDSQTTQQLKNDKVEETLKASKQGTADSQKVQTIDQSKTNQNNQHSVAESAQLKNDETANQPKVEEESSVKQDIQPSKNVNQQDVATQSNERENNDIKGEDQSSKASNQHTQSSNSHNQSIGTKDSDSEEIDQPLVKLQKPSNDSTYQTQSKAKQDSSKQLPQEKTTKHQIQTTENEQTTNVNSKKANDTQDARQHTQEPKNDTSTSQKNHHQVATKEQSNRSTTRETQKQSANSNRNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHKPATDKGVWQVRPVQHDWDHLDLVGMDAFDLTHTGRELGQFYLGIMDNIMRIEEADGITNK

SEQ ID NO: 42492 - protein, 728 aa, Staphylococcus epidermidis NIHLM053
MKNKKNSYSIRKLSVGASSIIVASMLFIGGGSVHAAESNQLENQEQSEVSASHSIELQHKDQEIQQPENKDNKNYHSETIDKNPTIHNNDYSYHETPSTDVKSNESKQIDNQSNQPQTFMTKNDQQNPKKVAEHTTKGINAKKEETRKNENAKSLVQPQQDDKTTSEQTKMKESREQDITNEQKQLQSKDVKNVQQENQNIDQEKSQEKINLQQSSIEKAQKSSRIDEKLDHQYNKDATQSNEDTASENVLEQHITAKDEGVTRNNRGDERLNQEKSTTSSDKELKVDDIDKDLSTKESPENEKDDSRKGIKALTKNSQATTRNTATTEASKELKDQTNKVASQKEYKNHDPIILVHGFNGYASGTGPITGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42493 - protein, 291 aa, Staphylococcus epidermidis NIHLM053
MKKIDSWLTKHGLKNRLTLAVIVIFIIFLILLFMFVNLSDEDTGQITITENAELRTGPNAAYPVIYKIEKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 42494 - protein, 434 aa, Staphylococcus epidermidis NIHLM053; identical to SEQ ID NO: 39380

SEQ ID NO: 42495 - protein, 235 aa, Staphylococcus epidermidis NIHLM053; identical to SEQ ID NO: 42009

SEQ ID NO: 42496 - protein, 25 aa, Staphylococcus epidermidis NIHLM053
MAADIISTIGDLVKWIIDTVNKFKK

SEQ ID NO: 42497 - protein, 219 aa, Staphylococcus epidermidis NIHLM053
MKKTLVASSLAIGLGVVAGNAGHDAHASETTNVDKAELAQKALTNDQSLNESPVQEGAYNINFDYNGNSYHFESDGSTWSWSYESTNNATQPVQPSQSQVATQQQPVQVSAPQNEQTTQPQTKSTSASQTSSSKASSGSSVNVNSHLQQIAQRESGGDIHAINPSSGAAGKYQFLQSTWDSVAPSQYKGVSPAKAPESVQDKAAVKLYNTGGPGHWVTA

SEQ ID NO: 42498 - protein, 357 aa, Staphylococcus epidermidis NIHLM053
MKDIKPNNSKLIQTYLSKKTIRYGTASALTLALYLFNSNVTVYADENTANQGTSPKTSQTAPTNNNENTDATAVTTDQNNNDEEEYDASYELPILYVTVWLDDQGNIIKDAVEDAKTPASERQPVKIPGYQHYRTSVSDGITKFIYRKISTAQSPIVENSQHNNTNKVVETTNQNKDEVNGKEQNQANTSVTNTQITKNEKDEDTKTLQKDKDEKESKDRKTPKKDKKEKITKTPKKDREEKKPVIPSNGKVEKDEDRKTPKKDKKEKITKTSKKDKEEKSPAIPKSGKDEKKSKDTKITKKDKEDEITTTSKKDNNNDVQDKLPETGKTNDIQNPALIMLLAGLGLLGLFRNKIRE

SEQ ID NO: 42499 - protein, 327 aa, Staphylococcus epidermidis NIHLM053
MNWQRKCILTTLLVLSSLFLVFSTITYASERDYKDSLKITTHNVYFLPTAIYPNWEQSQRADLISKADYIQNQDVVILNELFDKKASKRLLARLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42500 - protein, 688 aa, Staphylococcus epidermidis NIHLM053
MKTRQNKYSIRKFSVGASSILIAALLFMGGGSAQAAEQQQDKGTVENSTTQSIGDENEKLSEQQSTQNKNVNEKSNVNSITANENLHNETPKNEDLIQQQKDSQNDNKSESVVEQNKKNEAFVQNHSEEKPQQKQVELEKHASENNQTLHSNAAQSNEDVKTKPSQLDNTTAQQEDSQKENLSKQDTQSSKNTDLLRATGQNQSKDSQSTEEVNKEVNNDTQQVTAKKDDDKVETFNLNSKEEPLKVDKQANPTTDNDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLVYDVGKMYGNKDSRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 42501 - protein, 98 aa, Staphylococcus epidermidis NIHLM053; identical to SEQ ID NO: 42398

SEQ ID NO: 42502 - protein, 357 aa, Staphylococcus epidermidis NIHLM057; identical to SEQ ID NO: 42498

SEQ ID NO: 42503 - protein, 681 aa, Staphylococcus epidermidis NIHLM057; identical to SEQ ID NO: 42491

SEQ ID NO: 42504 - protein, 235 aa, Staphylococcus epidermidis NIHLM057; identical to SEQ ID NO: 42009

SEQ ID NO: 42505 - protein, 25 aa, Staphylococcus epidermidis NIHLM057
MAADIISTIGDLVKWIIDTVNKFKK

SEQ ID NO: 42506 - protein, 327 aa, Staphylococcus epidermidis NIHLM057; identical to SEQ ID NO: 42499

SEQ ID NO: 42507 - protein, 291 aa, Staphylococcus epidermidis NIHLM057; identical to SEQ ID NO: 42493

SEQ ID NO: 42508 - protein, 728 aa, Staphylococcus epidermidis NIHLM057; identical to SEQ ID NO: 42492

SEQ ID NO: 42509 - protein, 86 aa, Staphylococcus epidermidis NIHLM057; identical to SEQ ID NO: 42007

SEQ ID NO: 42510 - protein, 219 aa, Staphylococcus epidermidis NIHLM057; identical to SEQ ID NO: 42497

SEQ ID NO: 42511 - protein, 688 aa, Staphylococcus epidermidis NIHLM057; identical to SEQ ID NO: 42500

SEQ ID NO: 42512 - protein, 434 aa, Staphylococcus epidermidis NIHLM057; identical to SEQ ID NO: 39380

SEQ ID NO: 42513 - protein, 681 aa, Staphylococcus epidermidis NIHLM061; identical to SEQ ID NO: 42407

SEQ ID NO: 42514 - protein, 928 aa, Staphylococcus epidermidis NIHLM061; identical to SEQ ID NO: 42399

SEQ ID NO: 42515 - protein, 775 aa, Staphylococcus epidermidis NIHLM061
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTLPADQENNAPQAGAGTPGAENTPQAGGENHNQDNAVTAAGTSGEQNGGKPATSTTGQDAAQPNGPQGTSVAQPSNDASSQGHDTPQADAGTHNTEGQPAVTTGEQAGGKPAATKPEGADTETAPVPNTADENHAQPSPQSGGTTATQAGQVKPSGDSTPTGKPNTADDQGTQIKPTSNQGTTATTGETGNQKPSGQTGNTENTPNNGTQVKPNNNPAVTGTPNANEEQTGQPNATVTPGQGNDEINGATKPGEVSPKPEENNPAVTEPGTTAPGNTNQGTQVKPNPDQNNNPTTGQDTDQTGQSTQVKPNNDQTATGTQGATGDQNTQQGNTEQNNQNAEQGNTGQEGSNPNQSAQLGATVKPGSAPTQDTEVKPNPDQNNNPTTGQDADQTGQGTQVKPNNNQTATGTQGATGDQNTQQGNTEQNNQNAEPSAPGTTDQAGATVKPGSAPNQDTEVKPNPDQNNNSPTGQDADQTGQGTQVKPNNDQTATGTQGATGDQNTQQGNTEQNSQNAEQGNTGQEGSNPNQSGQLGATVKPGSATNQDTEVKPNPDQNNKPTTGQDADQTGQSTHVKPNNNQTATGTQDAIGDQNTQQGNAGNKGNAGNKGNTDKDAKVNTNDDETKTDVKNGTELPETGLSNEHDYTTTVFGSIALISSLLLLRRQRKESK

SEQ ID NO: 42516 - protein, 728 aa, Staphylococcus epidermidis NIHLM061
MKNKKNSYSIRKLSVGASSIIVTSMLFIGGGSVHAAESNQLENQEQSEVSASHSIELQHKDQEIQQPENKDNKNYHSETIDKNPTIHNNDYSYHETPSTDVKSNESKQIDNQSNQPQTSMTKNDQQNPKKVAEHTTKGINAKKEETRKNENAKSLVQPQQDDKTTSEQTKMKESREQDITNEQKQLQSKDVKNVQQENQNIDQEKSQEKINLQQSSIEKAQKSSRIDGKLDHQYNKDATQSNEDTASENVSEQHITAKDEGVTRNNRGDERLNQEKSTTSSDKELKVDDIDKDLSTKESPENEKDDSRKGIKALTKNSQATTRNTATTEASKELKDQTNKVASQKEYKNHDPIILVHGFNGYASGTGPITGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42517 - protein, 219 aa, Staphylococcus epidermidis NIHLM061; identical to SEQ ID NO: 42003

SEQ ID NO: 42518 - protein, 434 aa, Staphylococcus epidermidis NIHLM061
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDCIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 42519 - protein, 402 aa, Staphylococcus epidermidis NIHLM061
EQPTIKVDDPSKLPDGNTPGTSNVDVTVTYPDGTQDHVTVPVTTNKQADNDAYEPTTDEVTKDYGTPTTEDDVTGAVTIPNYPSEKGKPTIKVDDPSTLPDGNTPGTSNVDVTVTYPDGTQDHVTVPVTTNPEKDVIAPDAPTINQPSVGDKTISGKGEPGSTITVTFPDGSTTTGKVDGNGDWTVTVPDEITLHEGDKITAISTDDSGNKSNPTDTTVVDHDDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKDVDKDHSDKEALPQTGEQSNSNNATLFGSLFAGLGSLFLFGRRRKKDADNK

SEQ ID NO: 42520 - protein, 25 aa, Staphylococcus epidermidis NIHLM061
MAADIISTIGDLVKWIIDTVNKFKK

SEQ ID NO: 42521 - protein, 327 aa, Staphylococcus epidermidis NIHLM061
MNWQRKCILTTLLVLSSLFLVFSTITYASERDYKDSLKITTHNVYFLPTAIYPNWGQSQRADLISKADYIQNQDVVILNELFDKKASKRLLARLHSQYPYQTPIVGKGTEGWQNTTGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42522 - protein, 838 aa, Staphylococcus epidermidis NIHLM061
TEITPITIESEDNSGQAVTNKVDGLPAGVTFDEATNTINGTPSEVGSYDVTVTTTDESGNSETTIFTIDVKDTTKPTVESVADQTQEVNTEIEPIKIEARDNSGQAVTNKVDGLPAGVTFDEATNTISGTPNEVGSYDIKVTTTDESGNSETTIFTIDVKDTTKPTVESVADQTQEVNTEIESIKIEARDNSGQAVTNKVDGLPAGVTFDEATNTISGTPSEVGSYTVTVTTTDESGNSETTTFTIDVEDTTKPTVEDIADQTQEVNTEIDPIKIEATDNSGQAITNKVDGLPDGVTFDEVTNTISGTPSKVGSYTVTVTTTDESGNSETTTFTIDVEDTSKPTVESVADQTQEVNTEIEPIKIEATDNSGQAVTNKVDGLPDGVTFDETTNTISGTPSEVGSYDVTVTTTDESGNATETTFTINVEDTTKPTVESIANQTQEVNTEITPITIESEDNSGQAVTNKVEGLPAGVTFDEATNTISGTPTEVGKYLITITTIDKDGNTATTTLTINIIDTTAPEQPTINKVTENSTEVSGRGEPGTIVEVTFPDGNKVEGKVDSDGNYHIQVPSETTLKGGQPLQVIAIDKAGNKSETTTTTVIDTTAPEQPTINKVTENSTEVSGRGEPGTIVEVTFPDGNKVEGKVDSDGNYHIQIPSDEKFKVGQQLIVKVVDEEGNVSEPSIATVHEEDKNSEKPGTVTDTVTKNNSKSLKHKASEQQSYHNKSEKIMSVNKPTKIVEKDMSTYDYSRYSKDISNKNNKSATFEQQNVSDINNNQYSRNKVNQPVKKSRTNEINKDLPQTGEENLNKSTLFGTLVASLGALLLFFKRRKKDEDGKE

SEQ ID NO: 42523 - protein, 291 aa, Staphylococcus epidermidis NIHLM061; identical to SEQ ID NO: 42395

SEQ ID NO: 42524 - protein, 1155 aa, Staphylococcus epidermidis NIHLM061
MKNKQGFLPNLLNKYGIRKLSAGTASLLIGATLVFGINGQVKAAETDNTFSQNEDNKTNDSKSSDEELVKSEDDQISNTSADTTLESEFEQNNNPSSIEESTNRNDEDTLSQRTSTETETDTHVKSADNQTTNETTNKNDDNATTNHTESTSDESTYQSDDLNTTQHDNSNTNQDTQSTLNPTSKESSNKDEATSSTPKESTNIEKTSLSNDTNHQTTDEVNHSDSNNMTNSTPNDIENELDTTQLTSHDESPSPQSDNFTGFTNLMATPLNLRNDNSRINLLAATEDTKPKTYTKPNNSEYSYLLNDLGYDATTVKENSNLRHAGISQSQDNTGSVIKLNLTKWLSLQSNFVNGGKVNLSFAQSDFYTQIESITLSGVKMDTTNNGQNWSAPINGSTVNSGEIGSVTNHEILITLKNSQTLSSLGYSNNRPVYLTHTWTTNDGAIAEESIQVASITPTLDSKAPNTTQKSGFTAGRVINKIKYDSSQKSIKSVHTFKPNENFLQTDYRAVLYVKEQVNKELIPYIDPNSVKLYVSDPDGKPISQDRYVNGSIDNDGLFDSSKINEISIKNNNTSDQLSNARTSLDKNVFFGTLGQSRSYTISYKLKDGYTLESIASKVSARETFDSWMEVDYLDSYDSGAPNKRLFGSYASSYIDMIDRIAPVAPKANNITTEDTSIKGTAEADTNINLTFSDGRTLNGKVDTNGNFSITIPSDYVLTGKETIKITSIDKGDNVSPAITISVIDKTPPAVKAISNKTQEVNTAFNPFIIEATDNSGDKVMHDVRGLPAGVTFNNSSNMISGTPTDVGLYTVTVISRDVKGNETETSFKINVVDTTKPTVESVADQTQEVNTEIEPIKIEATDNSGQTVMNKVEGLPDGVTFDEATNTISGTPSEVGSYTVTVTTTDESGNATETTFTINVEDTTKPTVESVADQTQEVNTEITPIKIEARDNSGQAVTNKVEGLPDGVTFDETTNTISGTPSEVGSYTVTVTTTDESGNSETTTFTIDVKDTTKPTVEDIVDQTQEVNTEITPITIESEDNSGQAVTNKVEGLPDGVTFDETTNTISGTPSEVGSYTVTVTTTDESGNSETTTFTIDVEDTTKPTVESVADQKQEVNTEIEPIKIEATDNSGQGVTNKVDGLPAGVTFDEATNT

SEQ ID NO: 42525 - protein, 688 aa, Staphylococcus epidermidis NIHLM061
MKTRQNKYSIRKFSVGASSILIAALLFMGGGSAQAAEQQQDKGTVENSTTQSIGDENEKLSEQQSTQNKNVNEKSNVNSITENENLHNETPKNEDLIQQQKDSQNDNKSESVVEQNKKNEAFVQNHSEEKPQQEQVELEKHASENNQTLHSNAAQSNEDVKTKPSQLDNTTAQQKDSQKENLSKQDTQSSKNTDLLRATGQNQSKDSQSTEEVNKEVNNDTQQVTAKKDDDKVETFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLVYDVGKMYGNKDSRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQRFWHGLADDLVQSEQLTSTNK

SEQ ID NO: 42526 - protein, 235 aa, Staphylococcus epidermidis NIHLM061; identical to SEQ ID NO: 42400

SEQ ID NO: 42527 - protein, 178 aa, Staphylococcus epidermidis NIHLM061
MKKTRKKLDFLPNKLNKYSIRKFTVGTASILVGATLIFGAGHNVAEATEEDGSTNQSSTEDKTTSESTETNQSPTEDKTTSESTETNQSSTEDKTTSESTETNQSSTEDKTTSESTETNQSPTEDKTTSEGTETNQPSTEDKTTSESTKTNQSSTEDKTTSESTETNQSSTEEKATSE

SEQ ID NO: 42528 - protein, 3692 aa, Staphylococcus epidermidis NIHLM061
MNLFRKQKFSIRKFNIGIFSALIATVAFLAHPGQATASELEPSQNNDTTAQSDGGLENTFQSNPISDETTNTLSEQTVPSSTENKQTQNDPHHNNQPIAINAEEAESAQTPPYTNIYENNDTSDNGLHVNQPVKHHIEAQSEDVTNHTNSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELLTTLISRVSASREINDKAQEMTDGVYDSTELTTEEKDTLVDQIENHKNEISNNIDDELTDDGVERVKEAGLHTLESDTPHPVTKPNARQVVNNKAEQQKTLIRNNHEATTEEQNEAISQVEAHSSDAIAKIGEAETDTTVNEARDNGTRLIATDIPNPTKKAEAREAVTNSANSKIKNINNNTQATLDERNDAITLVNRSKDEAIQNINTAQGNDDVTEAQNNGTNTIQQVPLTPVKRQNAIATINAKADEQKRLIQANNNATTEEKADAERKVNEALLTATQNISNAPTNRDVDQAQTMGSGIISTISPATKIKEDARVAVEAKAIAQNQQINSNNMATTEEKQDALNQVEAHKQATIANINQAQSTQQVSEAKNNGINTINQDQPNAVKKNNTKTLLEQKGNEKKSAIAQTPDATTEEKQEAVSVVSQAVTNGNNHINQANSNDDVDQALSNAEQIITHTDVNVQKKPQARQALIAKVNEKQSAINTDNEGTIEEKQKAIQSLNDAKNSADEQITQAASNQNVDNALNIGISNISKIQTNFTKKQQARDQVNQKFQEKEAELNSTPHATQDEKQDALTRLTQVKESTLNDINQAQTNQNVDTALTNGIQNIQNIQVDVRKKQEARTTINDIVQQHKQTIQNNDDATTEEKEVANNLVNVSQQNVISKIDNATTNNQIDGIVSDGRQTINAITPDTSIKRNAKNDIEGKAADRKIKIQRINDATAEEIQEANRKIEEAKIEAKDNIQHSSTRDQVNEAKTNGINKIENITPATTVKSEARQAVQNKANEQINHIQNTPDATNEEKQEAINRVSAELARVQAQINAEHTTQGVKNIKDDAITSLSRINAQVVEKESARNAIEQKSTQQTQFINDNDNATDEEKEVANNLVIARKQNALDNINSLSSNSDIENAKVTGINEIAKVLPATSVKSKAKKDIDQKLAQQINQIQTHQTATIEEKEAAIQLANQKANEARTAIQNEHSNNGVAQAKSNGIHEIELVTPDAHKKSDAKQSIDDKYNEQSNTINTTPDATDEEKQKALDKLKIAKDAGYNKVDQAQTNQQVSDAKTEAIDTITNIQANVAKKPSARMELDSKFEDLKRQINATPNATEEEKQDAIQRLNVKREEVKNLINQDRRDNDVEQHKNTGLQELETIHANPTRKSDALQELQTKFISQTELINNNKDATNEEKAEAKRLLEISKNKTITNINQAQTNNQVDNAKDNGMNEIATIIPATTIKTDAKTAIDKKAEQQVTIINGNNDATDEEKAEARKLVEKAKTEVKSNITNSDTEREVNSAKTNGLEKINNIQPSTQTKTNAKQEINDKAQEQLIQINNTPDATEEEKQEATNRVNAGLAQSIQNINNAHSTQEVNESKTHSIATIKSILPNVIKKPTAINDLTQEANNQKTLIGNDGNATDDEKEAAKQLVTQKLNEEIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQDTNGVNDRIQAALANQNVTDEKNNILETIRNVEPIVVVKPKANEIIRKKAAEQTTLINQNQDATLEEKQIALGKLEEVKNEALNQVSQAHSNNDVKIAENNGIAKISEVHPETSIKRNAKQEIEQVAQSQIDTINANNKSTNEEKSAAIDRVNVAKIDAINNIANATTTQLVNDAKNNGNTSITQILPSTAVKTNALAALATDAKNKNAIIDQTPNATAEEKEEANNKVDRLQEEADANILKAHTTEEVNNIKNQAVQNINAVQVEVIKKQNVKNQLNQFVDNQKKIIENTPDATLEEKAEANRLLQNVLTSASDEIANVVHNNEVDQALDKARPKIEAIVPQVSKKRDALNAIQEAFNSQTQEIQENQEATNEEKTEALNKINQLLNQAKVNIDQAQSNKDVDNVKTRSIQDIEQIQAHPQTKETGRHRLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATDDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINRANTDNEVDNAKTSGLNNINEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTPDVTHEERNDAINHVKEQLSLVFNAIEKDQKDIQVAQDELFGLNELNSIFINITQKPTARKAISDKASQLNNSINNTPYATEEERQIALNKVKAIVEDANEKIREANTDSEVLGTKSNAITLLQAISADVQVKPQAFEEINAQAEIQRERINGNSDATREEKEEALKQVDTLVNKSFITINNVNKNQEVYDTKNKTIEAIHKIKPITIIKPQALNEITNQLDAQRDLIKNNNESTLEEKASAIDKLIKTAARIAEAIDKAQTNEDVKNIKKQSIDEVSKILPVIEIKLAARNEIHQKAEVIRGLINNNEEATKEEKDVALNQLDTTLTQANLSIDQALTNEAVNRAKEIATSEINKISVITIKKPEAIAEIQELADKKLNKFKQNQEATIEEKQSAINELDQALKSAINHIHQSQNNESVSAALKESISLIDSIEIQAHKKLEAKAYIDGYSDDKINDISSRATNEEKQIFVSKLKALINRAHKQIDEAETFVSVDTIVRNFKVEVDKLNSIVRKKAKALKEIELEADHVKQMINANLSASTRVKQNARTLINEIVSNALSQLNKVTTNKEVDELVNETIEKLKSIQLREDKILSSQRSTTSMTEKSNQCYSSENNTIKSLPETGNVDKSVPLAGVTLISGLAIMSSRKKKKDKKVND

SEQ ID NO: 42529 - protein, 405 aa, Staphylococcus epidermidis NIHLM061; identical to SEQ ID NO: 42402

SEQ ID NO: 42530 - protein, 235 aa, Staphylococcus epidermidis NIHLM067; identical to SEQ ID NO: 41955

SEQ ID NO: 42531 - protein, 681 aa, Staphylococcus epidermidis NIHLM067
MTNNNRIKRFSIRKYAVGVVSIITGVTIFIGGQQAQAAETSVQHADAHPEDSQTTQQLKNDKVEETLKASKQGTADSQQVQTIDQSKTNQNNQHSVAESAQLKSDETANQPKKEEGSSVKQDVQPSKNVNQQDVATQSNERENNDIKGEGQTSKTSNQHIQSPNSHNQSTGTKDSYSEEIDQPLVKLQKPSNDSTYQTQSKTKQDSSKQLPQEKTTKRQIQTTENEQTTKADSKKANDTQNVEQHTQEPKNDTSTSQKNHHQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYLDYAERVSKSKIWNTEDQAVNDLTTQGAEKINQQTSLNPNIVYTTYTGSATHIGPLGNELPNSSEILLLNLTSRIIGKDVNKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42532 - protein, 883 aa, Staphylococcus epidermidis NIHLM067
MINKKNNLLTKKKPIANKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDS

SEQ ID NO: 42533 - protein, 103 aa, Staphylococcus epidermidis NIHLM067
KPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42534 - protein, 25 aa, Staphylococcus epidermidis NIHLM067
MAADIISTIGDLVKWIIDTVNKFKK

SEQ ID NO: 42535 - protein, 815 aa, Staphylococcus epidermidis NIHLM067
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASIQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDHTGQGTQVKPNPDQTATGTQGATGDQNTQQGNTEQNNQNAEQGNTGGTDKDAKVNTNDDETKTDVKHDTELPETGLSNEYDYTTTVFGSIALISSLLLLRRQRKESK

SEQ ID NO: 42536 - protein, 434 aa, Staphylococcus epidermidis NIHLM067; identical to SEQ ID NO: 39380

SEQ ID NO: 42537 - protein, 137 aa, Staphylococcus epidermidis NIHLM067
MDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSEPTKAEEGGNG

SEQ ID NO: 42538 - protein, 144 aa, Staphylococcus epidermidis NIHLM067
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSEPTKAE

SEQ ID NO: 42539 - protein, 219 aa, Staphylococcus epidermidis NIHLM067; identical to SEQ ID NO: 39379

SEQ ID NO: 42540 - protein, 343 aa, Staphylococcus epidermidis NIHLM067
MKDIKPNNSKLIQTYLSKKTIRYGTASALTLALYLFNSNVTAYANENTANQNQETSPKTSQTAPISNKENTDSTAVTTDQNNNDEEEYDASYELPILYVTVWLDDQGNIIKDAVEDAKTPASERQPVKIPGYQHYRTSVSDGITKFIYRKISTAQSPIVENNQQDNNTNKVVETTNQNKDEVNEKEQNQANTSVTNTQINKNEKDEDKNTPQKDKDEKDTKTPKKDREEKKPVIPKSGKDEKESKDRKTPKKDKKEKITKTPKKDREEKKPVIPKSGKDEKDTKITKKDKEDKITTTSKKDNNNDVQDKLPETGKTNDIQNPALIMLLAGLGLLGLFRNKIRE

SEQ ID NO: 42541 - protein, 291 aa, Staphylococcus epidermidis NIHLM067; identical to SEQ ID NO: 41958

SEQ ID NO: 42542 - protein, 327 aa, Staphylococcus epidermidis NIHLM067
MNWQRKCILTTLLVLSSLFLVFSTITYASERDFKDSLKITTHNVYFLPTAIYPNWGQSQRADLISKADYIQNQDVVILNELFDKKASKRLLTRLHSQYPYQTPIVGKGTEGWQNTSGTYRKIKKVSGGVGIVSKWPIVHQEQHIYKKGCGADMAGNKGFAYIKINKNGKYHHIIGTHLQAEDPTCFKGKDKDIRESQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42543 - protein, 983 aa, Staphylococcus epidermidis NIHLM067
MFGAEDNEAKAAEDNQLESASKEEQKGSRDNESSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSISTDSSVNDKQDYTRSAVASLGVDSNETEAITNAVRDNLDLKAASREQINEAIIAEALKKDFSNPDYGVDTPLALNTSQSKNSSHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNLTIDSGFYKTPKYSVGDYVWKDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDSDSDSDADSDSDSDSDSDSDSDSDADSDSDSDSDSDSDSDSDSDSDKNAKDKLPDTGANEDHDSKGTLLGALFAGLGALLLGRRRKKDNKEK

SEQ ID NO: 42544 - protein, 688 aa, Staphylococcus epidermidis NIHLM067; identical to SEQ ID NO: 41949

SEQ ID NO: 42545 - protein, 190 aa, Staphylococcus epidermidis NIHLM067
MKKVLALLFASTLILGACGDKNDESKNDSSSNSTDSVSVDKNDNEDKTTAKFKNDKLTTDNFDIEILEAKTVKASEYDDDKKPSIAIIYGVKNKKDKDLTASSAFIESFDIYQNSKDVKRRLEIGGGYDTDLKEKYEEDMDNKINKDGKVKGVMFFKLKDTKTPVTLEAKDPNHSNNKKVGTKEFKIKEK

SEQ ID NO: 42546 - protein, 728 aa, Staphylococcus epidermidis NIHLM067; identical to SEQ ID NO: 39721

SEQ ID NO: 42547 - protein, 291 aa, Staphylococcus epidermidis NIHLM070; identical to SEQ ID NO: 41958

SEQ ID NO: 42548 - protein, 25 aa, Staphylococcus epidermidis NIHLM070
MAADIISTIGDLVKWIIDTVNKFKK

SEQ ID NO: 42549 - protein, 728 aa, Staphylococcus epidermidis NIHLM070; identical to SEQ ID NO: 42297

SEQ ID NO: 42550 - protein, 688 aa, Staphylococcus epidermidis NIHLM070; identical to SEQ ID NO: 39381

SEQ ID NO: 42551 - protein, 85 aa, Staphylococcus epidermidis NIHLM070; identical to SEQ ID NO: 41995

SEQ ID NO: 42552 - protein, 106 aa, Staphylococcus epidermidis NIHLM070
MKKKLDFLPNKLNKYSIRRFTVGTASILVGSTLLFGIGNEAHAAEKNQESNTTANVADSDVGEAPSKEEAPSNEATNEAPSKEEAPSNEATNEAPSKEEAPSNEAT

SEQ ID NO: 42553 - protein, 581 aa, Staphylococcus epidermidis NIHLM070
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPSTTPNQDAEVKPNPDQNNTPTNGQDGNQTGQGTQVKPNNDQTATGTQGATGNQNAEQGNTEQNNQNAEQGNTGQEGSNPNQSGQLGATVKPGSAPNQDTEVKPNPDQNNNPTTGQDANQTGQGTQVKPN

SEQ ID NO: 42554 - protein, 235 aa, Staphylococcus epidermidis NIHLM070; identical to SEQ ID NO: 41955

SEQ ID NO: 42555 - protein, 219 aa, Staphylococcus epidermidis NIHLM070; identical to SEQ ID NO: 39379

SEQ ID NO: 42556 - protein, 139 aa, Staphylococcus epidermidis NIHLM070
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAPQSEPTKAEEGGNAEAPQSE

SEQ ID NO: 42557 - protein, 327 aa, Staphylococcus epidermidis NIHLM070; identical to SEQ ID NO: 42282

SEQ ID NO: 42558 - protein, 881 aa, Staphylococcus epidermidis NIHLM070
MINKKNNLLTKKKPIANKSNKYAIRKFTVGTVSIVIGATLLFGLGHNEAKAEENSVQDVKDSNTDDELSDSNDQSSDEEKNDVINNNQSINNDDNNQIIKKEETNNNDGIEKRSEDRTKSTTNVDENEATFLQKTPQDNTHLTEEEVKEPSSVESSNSSIDTAQQPSHTTINREESVQTSDNVEDSHVSDFANYKIKESNTESGKEENTLEQPNKVREDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKAYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDS

SEQ ID NO: 42559 - protein, 434 aa, Staphylococcus epidermidis NIHLM070; identical to SEQ ID NO: 39380

SEQ ID NO: 42560 - protein, 110 aa, Staphylococcus epidermidis NIHLM070
GTPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42561 - protein, 128 aa, Staphylococcus epidermidis NIHLM070
SESDSESHSDSESDSDSESTSESDSESHSDSESDSDSESTSESDSESHSDSESHSDSESTSESDSESHSDSESDSDSESTSESGSESHSNSELPDTGEEDNHQGLIGGVLAAFGGLTLLGRRRKKEEK

SEQ ID NO: 42562 - protein, 1223 aa, Staphylococcus epidermidis NIHLM087
MKKRRQGPINKRVDFLSNKVNKYSIRKFTVGTASILVGATLMFGAADNEAKAAEDNQLESASKEEQKGNRDNESSKLNQVDLDNGSHSSEETTNVNNATEVKKVEAPTTSDVSKPKTNETVVTNESTKPKKAEAPTVNEESITETPKTSTTQQDSTEKNNPSLKDNLNSSSTTSKESKTDEHSTKQAQMSTNKSNLDTNDSPTQSEKTSPQANNGSTDNQSAPSKQLDSKPSEQKVYKTKFNDEPTQEVENTTTKLKTPSISTDSSVNDKQDYTRSAVASLGVDSSETKAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSNDGSIVANGVYDKATNTTTYTFTNYVDQYQNITGSFDLIATPKRETAIKDNQSYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFASSMANGKKYIVTQAVRPTGTGNVYTEYWLTRDGTTNTNDFYRGTKSTTVSYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGQRDGTRKVVVAKGTINNADNMTVDTGFYLTPKYNVGDYVWEDTNKDGIQDDNEKGISNVKVTLKDKNGNTIGTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSSQDITVDSNGITTTGVINGADNLTIDSGFYKTPKYSVGDYVWEDTNKDGIQDDNEKGISGVKVTLKDEKGNIISTTTTDENGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKTNSGQDITVDSNGITTTGVI

SEQ ID NO: 42563 - protein, 358 aa, Staphylococcus epidermidis NIHLM087
MKDNKPNNSKLIQTYLSKKTLRYGTASALTLALYLFNSNVTVYADENTANQNQGTSPKTSQTAPTNNNENTDATAVTTDQNNNDEEEYDASYELPILYVTVWLDDQGNIIKDAVEDAKTPASERQPVKIPGYQHYRTSMSDGITKFIYRKISTAQSSIVENNQQDNNTNKVVETTNQNKDEVNGKEQNQANTSVTNTQITKNEKDKDTKTQQKDKDEKESKDAKTPKKDKKEKITKTPKKDREEKKPVIPSNGKDEKESKDIKTPKKDKKEKITKTPKKDREEKKPVIPKTGKDEKDTKITKKDNEDEITTSSKKDNNNDIQDKLPETGKSNDIQNPALIMLLAGLGLLGLFRNKIRE

SEQ ID NO: 42564 - protein, 235 aa, Staphylococcus epidermidis NIHLM087; identical to SEQ ID NO: 41955

SEQ ID NO: 42565 - protein, 688 aa, Staphylococcus epidermidis NIHLM087
MKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTARQEDSQKENLSKQDTQSSKTTDLLRATGQNQAKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVDKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42566 - protein, 137 aa, Staphylococcus epidermidis NIHLM087
MKKKLDFLPNKLNKYSIRRFTVGTASILVGSTLLFGVGNEAHAAEKNQESNTTANVVDSDVGEASSKEETPSDEAPNEASSKEETPSNEAPNEASSKEETPSNEAPNEASSKEETPSNEAPNEASSKEETPSNEAPK

SEQ ID NO: 42567 - protein, 681 aa, Staphylococcus epidermidis NIHLM087
MTNNNRIKRFSIRKYAVGVVSIITGVTIFIGGQQAQAAETSVQHADVHPEDSQTTQQLKNDKVEETLKASKQGTADSQQVQTIDQSKTNQNNQHSVAESAQLKSDETANQPKEEEGSSVKQDVQPSKNVNQQDVATQSNERENNDIKGEGQTSKAGNQHTQSSNSHNQSTGTKDSDSEEIDQPLVKVQKPSNDSTYQTQSKAKQDSSKQLPQEKTTKRQIQTTENEQTTKVDSKKANDTQDVEKHTQEPKNDTSTSQKNHHQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42568 - protein, 219 aa, Staphylococcus epidermidis NIHLM087; identical to SEQ ID NO: 42051

SEQ ID NO: 42569 - protein, 728 aa, Staphylococcus epidermidis NIHLM087
MKNKKNSYSIRKLSVGASSIIVASMLFIGGGSVHAAESNHLENQEQSEVSASHSIEMQHKNQETQQPENKDNKTNHSETIDKTPTIHSNGYSYHETPSTDVKSNEGKQIDSQSNQPQTSMPKNDQQNSKKVAEHATKSINAKKEETRKNENAKSLVQPQLDDKTTSEQTKMKESREQEITNEQKQLQSKDIKNAQQENQNIDQEKSQEKNKVQQSNIEKAQKSSRIDGKLDNQYNKDATQSNEGTASENVSEQHITAKDAGVTRNNRGDERLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQRDDETLVQYIQRVKQSKLWTTKDNGFYDLTTEGTDILNQKTSLNPNIVYKTYQGESTRPGANGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42570 - protein, 327 aa, Staphylococcus epidermidis NIHLM087
MNWQRKCILTTLLVLSSLFLVFSTITYASERDSKDSLKITTHNVYFLPTAIYPNWGQSQRADLISKADYIQNQDVVILNELFDKKASNRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYVSNE

SEQ ID NO: 42571 - protein, 25 aa, Staphylococcus epidermidis NIHLM087
MAADIISTIGDLVKWIIDTVNKFKK

SEQ ID NO: 42572 - protein, 3692 aa, Staphylococcus epidermidis NIHLM087
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDEYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42573 - protein, 291 aa, Staphylococcus epidermidis NIHLM087
MKKIDSWLTKHGLKNRLTLVVIVIFIIFLILLFMFVNLSDEDTGQITITENAELRTGPNAAYPVIYKIEKGETFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSAIQKKALLTNRGSRQQNYQVLRQTDIPAVLLELGYISNPTDESMINDQLHRQVVEQAIVDGLKQYFSS

SEQ ID NO: 42574 - protein, 225 aa, Staphylococcus epidermidis NIHLM087
DSDSDSDSDSDSDSDSDSDSDSDSDSDSDSDSDSDSDSDSDSDSDADSDSDADSDSDSDSDSDADSDSDSDSDSDSDSDSDADSDSDSDSDSDSDSDSDADSDSDSDSDSDSDSDSDSDSDSDADSDSDSDSDSDSDSDSDSDSDSDSDSDSDSDSDSDADSDSDSDSDSDSDSDSDSDKNAKDKLPDTGANEDHDSKGTLLGTLFAGLGALLLGRRRKKDNKEK

SEQ ID NO: 42575 - protein, 462 aa, Staphylococcus epidermidis NIHLM087
MKKSSKFSKDFPTRKNHYAIRKFTVGTASIIVGSFLFFGQTQAQAEEFERVTTGTVDTGGQPARADQGQEGPQAGADTHNTASQPGVTGQDAPNENHAGDQNAAVTHPADQENNAPQVGAGTPGAENTPQAGGENHNQENAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPLPQTGGTTATQAGQVKPSGDSTPTGEPNKADDQGTQTKPTSNQGTTATTDETGNQKPSGQTGNTENTPNEGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPGTTPNQDAEVKPNTDTNGNWYSSWY

SEQ ID NO: 42576 - protein, 434 aa, Staphylococcus epidermidis NIHLM087
MPIITDVYAREVLDSRGNPTVEVEVLTESGAFGRALVPSGASTGEHEAVELRDGDKSRYLGKGVSKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 42577 - protein, 681 aa, Staphylococcus epidermidis NIHLM088
MTNNNRIKRFSIRKYAVGVVSIITGATIFIGGQQAQAAETSVQHADAHPEDSQTTQQLKNDKVEETLKASKQGNADSQQVQTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQPLVKLQKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDYTPATDKGVWQVRPVQHDWDHLDLVGMDAFDLTHTGRELGQFYLGIMDNIMRIEEADGITNK

SEQ ID NO: 42578 - protein, 434 aa, Staphylococcus epidermidis NIHLM088; identical to SEQ ID NO: 39380

SEQ ID NO: 42579 - protein, 219 aa, Staphylococcus epidermidis NIHLM088; identical to SEQ ID NO: 39379

SEQ ID NO: 42580 - protein, 85 aa, Staphylococcus epidermidis NIHLM088; identical to SEQ ID NO: 41995

SEQ ID NO: 42581 - protein, 291 aa, Staphylococcus epidermidis NIHLM088; identical to SEQ ID NO: 39372

SEQ ID NO: 42582 - protein, 150 aa, Staphylococcus epidermidis NIHLM088
MKKRLDFMPNKQNKYSIRRFTVGTASILVGATLFLGIGNEAKADELVNQSSENKVETNQNAEDASELTKAPEQETSETQASKSTTAPEGKAVDENQSEQSTENSKEINNEKEETEEANKSTEQVTPETQASKSTTAPEGRTVDRKSIRNK

SEQ ID NO: 42583 - protein, 264 aa, Staphylococcus epidermidis NIHLM088
KITKDPVDEITEFGGEEIKPGHKDVFDPNAPVDSKEDIPGKPGIKNPETGETVKEPKDSITKYGPKAGEPETKTEDIPFDKKRKFNPDLKPGEERVVQKGEKGTKTITTPTTINPITGEKVGEGKPTEKITKEPIDQVVEYGPNKEYPSNPNKPGKPEQPTNNENNKSGDHQSSHSSNKGQSQEENGMDFEFNHDKKENSIQTNEHLDKHKDLSNKAHSSSDKKQLPDTGSNDTNNGTLIGSLLALIGSLFVFSRRKNKQNNEK

SEQ ID NO: 42584 - protein, 478 aa, Staphylococcus epidermidis NIHLM088
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQGTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPN

SEQ ID NO: 42585 - protein, 235 aa, Staphylococcus epidermidis NIHLM088; identical to SEQ ID NO: 41955

SEQ ID NO: 42586 - protein, 145 aa, Staphylococcus epidermidis NIHLM088
QPGDTEQPGDTEQPGDTEQPGDTEQPGDTEQPGDTEQPGDTEQPGDTEQPGDTEQPGDTEQPGDTELNSDYNNQTNSITSDNLVSSRNYLNKINSRQNLKNNAKQLPDTGENDQINKGSLLGSLLAVIGSIFILARRKNKKNIEK

SEQ ID NO: 42587 - protein, 882 aa, Staphylococcus epidermidis NIHLM088
MINKKNNLLTKKKPIANKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSD

SEQ ID NO: 42588 - protein, 25 aa, Staphylococcus epidermidis NIHLM088
MAADIISTIGDLVKWIIDTVNKFKK

SEQ ID NO: 42589 - protein, 122 aa, Staphylococcus epidermidis NIHLM088
MKKKLDFIPNKLNKFSIRRFTVGTASILVGSTLLFGIGNEAHAAEKNQELNTTANVADSDVGEAPSKEEAPSNEATNEALSKEEAPSNEATNEAPSKEEAPSNEATNEAPSKEEAPSNEATN

SEQ ID NO: 42590 - protein, 327 aa, Staphylococcus epidermidis NIHLM088; identical to SEQ ID NO: 42282

SEQ ID NO: 42591 - protein, 66 aa, Staphylococcus epidermidis NIHLM088
SESTSESDSDSESTSESDSDSESTSESDSELPDTGQEDHRAGLIGSMLAAFGGITLLGRRRKKEEK

SEQ ID NO: 42592 - protein, 688 aa, Staphylococcus epidermidis NIHLM088
MKTRQNKYSIRKFSVGASSILIAALLFIGGGSAHAAEQQQDKGTVENSTTQSIGDGNEKLSEQQSTQNKNVNEKSNVNSITENESLHNETPKNEDLIQQQKDSQNDNKSESVVEQNKENEAFVQNHSEEKPQQEQVELEKHASENNQTLHSKAAQSNEDVKTKPSQLDNTTAKQEDSQKENLSKQDTQSSKTTDLLRATGQNQSKDSQSTEEINKEVNNDTQQVTAKNDDGKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 42593 - protein, 728 aa, Staphylococcus epidermidis NIHLM088
MKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGNRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVCISKEELEDFWDNMFEDMVRNEKVTDKQ

SEQ ID NO: 42594 - protein, 327 aa, Staphylococcus epidermidis NIHLM095; identical to SEQ ID NO: 42570

SEQ ID NO: 42595 - protein, 681 aa, Staphylococcus epidermidis NIHLM095; identical to SEQ ID NO: 42567

SEQ ID NO: 42596 - protein, 3689 aa, Staphylococcus epidermidis NIHLM095
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDEYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKIKK

SEQ ID NO: 42597 - protein, 117 aa, Staphylococcus epidermidis NIHLM095
DSDSDSDSDSDSDSDADSDSDSDSDSDSDSDSDSDSDSDSDSDSDSDSDSDADSDSDSDSDSDSDSDSDSDKNAKDKLPDTGANEDHDSKGTLLGTLFAGLGALLLGRRRKKDNKEK

SEQ ID NO: 42598 - protein, 434 aa, Staphylococcus epidermidis NIHLM095; identical to SEQ ID NO: 42576

SEQ ID NO: 42599 - protein, 728 aa, Staphylococcus epidermidis NIHLM095; identical to SEQ ID NO: 42569

SEQ ID NO: 42600 - protein, 291 aa, Staphylococcus epidermidis NIHLM095; identical to SEQ ID NO: 42573

SEQ ID NO: 42601 - protein, 452 aa, Staphylococcus epidermidis NIHLM095
MKKSSKFSKDFPTRKNHYAIRKFTVGTASIIVGSFLFFGQTQAQAEEFERVTTGTVDTGGQPARADQGQEGPQAGADTHNTASQPGVTGQDAPNENHAGDQNAAVTHPADQENNAPQVGAGTPGAENTPQAGGENHNQENAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPLPQTGGTTATQAGQVKPSGDSTPTGEPNKADDQGTQTKPTSNQGTTATTDETGNQKPSGQTGNTENTPNEGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPGTTPNQDAEVKPNTD

SEQ ID NO: 42602 - protein, 133 aa, Staphylococcus epidermidis NIHLM095
MKKKLDFLPNKLNKYSIRRFTVGTASILVGSTLLFGVGNEAHAAEKNQESNTTANVVDSDVGEASSKEETPSDEAPNEASSKEETPSNEAPNEASSKEETPSNEAPNEASSKEETPSNEAPNEASSKEETPSN

SEQ ID NO: 42603 - protein, 219 aa, Staphylococcus epidermidis NIHLM095; identical to SEQ ID NO: 42051

SEQ ID NO: 42604 - protein, 1010 aa, Staphylococcus epidermidis NIHLM095
MKKRRQGPINKRVDFLSNKVNKYSIRKFTVGTASILVGATLMFGAADNEAKAAEDNQLESASKEEQKGNRDNESSKLNQVDLDNGSHSSEETTNVNNATEVKKVEAPTTSDVSKPKTNETVVTNESTKPKKAEAPTVNEESITETPKTSTTQQDSTEKNNPSLKDNLNSSSTTSKESKTDEHSTKQAQMSTNKSNLDTNDSPTQSEKTSPQANNGSTDNQSAPSKQLDSKPSEQKVYKTKFNDEPTQEVENTTTKLKTPSISTDSSVNDKQDYTRSAVASLGVDSSETKAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSNDGSIVANGVYDKATNTTTYTFTNYVDQYQNITGSFDLIATPKRETAIKDNQSYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFASSMANGKKYIVTQAVRPTGTGNVYTEYWLTRDGTTNTNDFYRGTKSTTVSYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGQRDGTRKVVVAKGTINNADNMTVDTGFYLTPKYNVGDYVWEDTNKDGIQDDNEKGISNVKVTLKDKNGNTIGTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSSQDITVDSNGITTTGVINGADNLTI

SEQ ID NO: 42605 - protein, 910 aa, Staphylococcus epidermidis NIHLM095
MFGLGHNEAKAEENSVQDVKDSNTDDELSDSNDQSSDEEKNDVINNNQSINTDDNNQINKKEETNSNNGIEKRSEDRTESTTNVDENEATFLQKTPQDNTHLTEEEVKEPSSVESSNSSIDTAQQPSHTTINREASVQTSDNVEDSHVSDFANSKIKESNTESGKEENTIEQPNKVREDSTTSQPSSYKNIDEKISNQDELLNLPINEYENKARPLSTTSAQPSIKRVTVNQLAAEQGSNVNHLIKVTDQSITEGYDDSEGIIKAHDAENLIYDVTFEVDDKVKSGDTMTVNIDKNTVPSDLTDSFTIPKIKDNSGEIIATGTYDNKNKQITYTFTDYVDKYENIKAHLKLTSYIDKSKVPNNNTKLDVDYKTALSSVNKTITVEYQKPNENQTANLQSMFTNIDTKNHTVEQTIYINPLRYSAKETNVNISGNGDEGSTIIDDSTIIKVYKVGDNQNLPDSNRIYDYSKYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSGSDSDSDSDSDSDSGSDSDSDSDSDSDSDSDSDSDSDSGNSSDKSTKDKLPDTGANEDYDSKGTLLGTLFAGLGALLLGKRRKNRKNKN

SEQ ID NO: 42606 - protein, 25 aa, Staphylococcus epidermidis NIHLM095
MAADIISTIGDLVKWIIDTVNKFKK

SEQ ID NO: 42607 - protein, 688 aa, Staphylococcus epidermidis NIHLM095
MKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTARQEDSQKENLSKQDTQSSKTTDLLRATGQNQAKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42608 - protein, 235 aa, Staphylococcus epidermidis NIHLM095; identical to SEQ ID NO: 41955

SEQ ID NO: 42609 - protein, 343 aa, Staphylococcus epidermidis SK135; identical to SEQ ID NO: 39377

SEQ ID NO: 42610 - protein, 918 aa, Staphylococcus epidermidis SK135
RVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDVSGHYQFKGLENGSYTVEFETPSGYTPTKANSGQDITVDSNGITTTGIINGADNLTIDSGFYKTPKYSVGDYVWKDTNKDSIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDSDSDSDSDSDSDSDSDSDSDSDSDSDADSDSDSDSDSDADSDSDSDSDSDSDSDSDADSDSDSDSDSDADSDSDSDSDSDADSDSDSDSDSDSDSDSDSDSDSDSDSDSDSDSDSDSDADSDSDSDSDSDADSDSDSDSDSDADSDSDADSDSDSDSDSDADSDSDADSDSDSDSDSDADSDSDSDSDSDSDSDSDSDSDSDSDSDSDADSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDADSDSDSDKNAKDKLPDTGANEDHDSKGTLLGTLFAGLGALLLGRRRKKDNKEK

SEQ ID NO: 42611 - protein, 681 aa, Staphylococcus epidermidis SK135; identical to SEQ ID NO: 42027

SEQ ID NO: 42612 - protein, 327 aa, Staphylococcus epidermidis SK135
MNWQRKCILTTLLVLSSLFLVFSTITYASERDFKDSLKITTHNVYFLPTAIYPNWGQSQRADLISKADYIQNQDVVILNELFDKKASKRLSTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42613 - protein, 693 aa, Staphylococcus epidermidis SK135
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGSNAEAPQSEPTKAEEGGNAEAAQSEPTKAEEGGNAEAAQSEPTKTEEGSNVKAAQSEPTKAEEGSNAEAPQSEPTKTEEGGNAEAPNVPTIKANSDNDTQTQFSEAPTRNDLARKEDIPAVSKNEELQSSQPNTDSKIEPTTSEPVNLNYSSPFMSLLSMPADSSSNNTKNTIDIPPTTVKGRDNYDFYGRVDIESNPTDLNATNLTRYNYGQPPGTTTAGAVQFKNQVSFDKDFDFNIRVANNRQSNTTGADGWGFMFSKKDGDDFLKNGGILREKGTPSAAGFRIDTGYYNNDPLDKIQKQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYASGVMRADLDGATLTYTPKAVDGDPIISTKEIPFNKKREFDPNLAPGTEKVVQKGEPGIETTTTPTYVNPNTGEKVGEGEPTEKITKQPVDEIVHYGGEEIKPGHKDEFDPNAPKGSQTTQPGKPGVKNPDTGEVVTPPVDDVTKYGPVDGDPITSTEEIPFDKKREFNPDLKPGEERVKQKGEP

SEQ ID NO: 42614 - protein, 774 aa, Staphylococcus epidermidis SK135
MDTAQQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 42615 - protein, 434 aa, Staphylococcus epidermidis SK135
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFKGIKSFYNLDK

SEQ ID NO: 42616 - protein, 815 aa, Staphylococcus epidermidis SK135; identical to SEQ ID NO: 39714

SEQ ID NO: 42617 - protein, 3692 aa, Staphylococcus epidermidis SK135
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEESESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRVQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIESKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42618 - protein, 291 aa, Staphylococcus epidermidis SK135; identical to SEQ ID NO: 39372

SEQ ID NO: 42619 - protein, 219 aa, Staphylococcus epidermidis SK135; identical to SEQ ID NO: 39379

SEQ ID NO: 42620 - protein, 430 aa, Staphylococcus epidermidis SK135
MKKFQNNTIQKKGLRKYNNKLIAVTISSLALAAPLAFGNASAHAAQTNDNSGQQKTVQSNENQGNGLLNGGLQGNKNEGGKADQTNAHQGNGVLNGGAQGNKSEGGDATQKNDNQGNGVANGGSQGNKNEGGKADQTNAHQGNGVANGGSQGNKNEGGDATQKNDNQGNGVANGGSQGNKNEGGKADQSNTNKGNGILNGGSQSNVNKGDHQDASKPSDNDHKDHSDDPKDDGKDNHHKGDKDDHHQGKDDGQDNHKKDKDHNDKDHHKGSKDDDTKKPDQSDKDDHHQGKDDGQDDSKSEPSKDTDNKGNHNTTSKDGKHNGKSPVAPITAATMTPAMTHAHGYGQGYGQGSASESTETPKTITTSTTETTPDKKEVTHGEKTEHSANELPETGEENQENKGLLASIASILGLSGLATLFVNRKRKTNE

SEQ ID NO: 42621 - protein, 235 aa, Staphylococcus epidermidis SK135; identical to SEQ ID NO: 41955

SEQ ID NO: 42622 - protein, 354 aa, Staphylococcus epidermidis SK135
MDDVTKYGPVDGDPITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGTPAEPGKPAEPGKPAEPGKPAEPGTPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42623 - protein, 728 aa, Staphylococcus epidermidis SK135; identical to SEQ ID NO: 39721

SEQ ID NO: 42624 - protein, 688 aa, Staphylococcus epidermidis SK135; identical to SEQ ID NO: 41949

SEQ ID NO: 42625 - protein, 235 aa, Staphylococcus epidermidis VCU028; identical to SEQ ID NO: 41955

SEQ ID NO: 42626 - protein, 104 aa, Staphylococcus epidermidis VCU028
MGKRRQGPINKKVDFLPNKLNKYSIRKFTVGTASILLGSTLIFGSSSHEAKAAEEKQVDPITQANQNDSSERSLENTNQPTVNNEALQSEPTKAEEGGNAEAPQ

SEQ ID NO: 42627 - protein, 291 aa, Staphylococcus epidermidis VCU028; identical to SEQ ID NO: 39372

SEQ ID NO: 42628 - protein, 177 aa, Staphylococcus epidermidis VCU028
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKEGKDH

SEQ ID NO: 42629 - protein, 434 aa, Staphylococcus epidermidis VCU028; identical to SEQ ID NO: 39380

SEQ ID NO: 42630 - protein, 731 aa, Staphylococcus epidermidis VCU028
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPGTTPNQDAEVKPNTDQTATGTQGATGDQNAEQGNTEQNNQNAEQGNTGQEGSNLNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNLDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 42631 - protein, 681 aa, Staphylococcus epidermidis VCU028
MTNNNRIKRFSIRKYAVGVVSIITGATIFIGGQQAQAAETSVQHADAHPEDSQTTQQLKNDKVEETLKASKQGNADSQQVQTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQPLVKLQKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQFKNQYPVVFVHGFLGFAGDNQFSLAPKYWGGTKYNIDRNLTNKGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42632 - protein, 327 aa, Staphylococcus epidermidis VCU028; identical to SEQ ID NO: 42020

SEQ ID NO: 42633 - protein, 219 aa, Staphylococcus epidermidis VCU028; identical to SEQ ID NO: 39379

SEQ ID NO: 42634 - protein, 343 aa, Staphylococcus epidermidis VCU028; identical to SEQ ID NO: 39377

SEQ ID NO: 42635 - protein, 217 aa, Staphylococcus epidermidis VCU028
DSDSDSDADSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDADSDSDSDKNAKDKLPDTGANEDHDSKGTLLGTLFAGLGALLLGRRRKKDNKEK

SEQ ID NO: 42636 - protein, 688 aa, Staphylococcus epidermidis VCU028; identical to SEQ ID NO: 39381

SEQ ID NO: 42637 - protein, 728 aa, Staphylococcus epidermidis VCU028; identical to SEQ ID NO: 42297

SEQ ID NO: 42638 - protein, 58 aa, Staphylococcus epidermidis VCU028
QSGAPEQPNRSMHSTDNKNQLPDTGENRQANEGTLVGSLLAIVGSLFIFGRRKKGNEK

SEQ ID NO: 42639 - protein, 138 aa, Staphylococcus epidermidis VCU037
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGGNAEAPQSEPTKAEEGGNAEAAQSEPTKAEEGGNAEAPQS

SEQ ID NO: 42640 - protein, 319 aa, Staphylococcus epidermidis VCU037; identical to SEQ ID NO: 42111

SEQ ID NO: 42641 - protein, 291 aa, Staphylococcus epidermidis VCU037; identical to SEQ ID NO: 39372

SEQ ID NO: 42642 - protein, 3692 aa, Staphylococcus epidermidis VCU037; identical to SEQ ID NO: 42099

SEQ ID NO: 42643 - protein, 1544 aa, Staphylococcus epidermidis VCU037
MKNKQGFLPNLLNKYGIRKLSAGTASLLIGATLVFGINGQVKAAETDNIVSQNGDNKTNDSESSDKELVKSKDDKTSSTSTDTNLESEFDQNNKPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLLNDANHQTTDEVNHSDSDNMTNSTPNDTENELDTTQLTSHDESPSPQSDNFTGFTNLMATPLNLRNDNPRINLLAATEDTKPKTYIKPNNSEYSYLLNDLGYDATTVKENSDLRHAGISQSQDNTGSVIKLNLTKWLSLQSDFVNGSKVNLSFAQSDFYTQIESITLRGVKMDTTNNGQNWSAPINGSTVNSGLIGSVTNHEILITLKNSQTLSSLGYSNNKPVYLTHTWTTNDGAIAEESIQVASITPTLDSKAPNTTQESGFTAGRVINKIKYDSSQKSIKSVHTFKPNENFLQTDYRAVLYIKEQVNKELIPYIDPNSVKLYVSDPDGNPISQDRYVNGSIDNDGLFDSSKINEISIKNNNTSGQLNNARTSLDRNVFFGPLGQSRSYTISYKLKDGYTLESIASKVSARETFDSWMEVDYLDSYDSGTPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNVTETIFTIDVEDTTKPTVESIAGQTQEVNTEIEPIKIEAKDNSGQTVTNKVDGLPDGVTFDEATNTISGTPSEVGSYTVTVTTMDESGNATETTFTIDVEDTTKPTVESVADQTQEVNTEITPITIESEDNSDQAVTNKVDGLPDGVTFDEATNTISGTPSEVGSYTVTVTTTDESGNATETTFTIDVEDTTKPTVKSVSDQTQEVNTEITPIKIEATDNSGQTVTNKVDGLPDGITFDEATNTISGTPSEVGSYDITVTTTDESGNATETTFTINVEDTTKPTVEDIADQTQEVNTEIEPIKIEATDNGGQAVTNKVDGLPDGVTFDEATNTISGTPSEVGSYDIIVTTTDENGNSETTTFTIDVEDTTKPTVEDIADQTQEINTEIEPIKIEARDNSGQAVTNKVDGLPDGVTFDEATNTISGTPSEVGSYDITVTTTDESGNATETTFTIDVEDTTKPTVEDITDQTQEVNTEITPIKIEARDNSGQTVTNKVDGLPDGVTFDEATNTISGTPSEVGSYTVTVTTTDESSNATETTFTIDVEDTTKPTVEDIADQTQEVNTEITPIKIEATDNSGQAVTNKVDGLPDGVTFDEATNTISGTPSEVGSYDITVTTTDENGNSETTTFTIDV

SEQ ID NO: 42644 - protein, 96 aa, Staphylococcus epidermidis VCU037
PAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42645 - protein, 688 aa, Staphylococcus epidermidis VCU037; identical to SEQ ID NO: 41949

SEQ ID NO: 42646 - protein, 219 aa, Staphylococcus epidermidis VCU037; identical to SEQ ID NO: 39379

SEQ ID NO: 42647 - protein, 55 aa, Staphylococcus epidermidis VCU037
DSDSESTSESGSESHSNSELPDTGEEDNHQGLIGGVLAAFGGLTLLGRRRKKEEK

SEQ ID NO: 42648 - protein, 728 aa, Staphylococcus epidermidis VCU037; identical to SEQ ID NO: 39721

SEQ ID NO: 42649 - protein, 233 aa, Staphylococcus epidermidis VCU037
PEQPTINKVTENSTEVNGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42650 - protein, 681 aa, Staphylococcus epidermidis VCU037; identical to SEQ ID NO: 42118

SEQ ID NO: 42651 - protein, 327 aa, Staphylococcus epidermidis VCU037; identical to SEQ ID NO: 42156

SEQ ID NO: 42652 - protein, 69 aa, Staphylococcus epidermidis VCU037
MLKKKLDFIPNKLNKFSIRRFTVGTASILVGSTLLFGIGNEAHAAEKNQELNTTANVADSDVGEAPSKE

SEQ ID NO: 42653 - protein, 235 aa, Staphylococcus epidermidis VCU037; identical to SEQ ID NO: 41955

SEQ ID NO: 42654 - protein, 205 aa, Staphylococcus epidermidis VCU037; identical to SEQ ID NO: 39382

SEQ ID NO: 42655 - protein, 827 aa, Staphylococcus epidermidis VCU037; identical to SEQ ID NO: 42123

SEQ ID NO: 42656 - protein, 434 aa, Staphylococcus epidermidis VCU037; identical to SEQ ID NO: 39380

SEQ ID NO: 42657 - protein, 1070 aa, Staphylococcus epidermidis VCU037
MINKKNNLLTKKKPIANKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDNDSDLGNSSDKSTKDKLPDTGANEDYGSKGTLLGTLFAGLGALLLGKRRKNRKNKN

SEQ ID NO: 42658 - protein, 815 aa, Staphylococcus epidermidis VCU041; identical to SEQ ID NO: 39714

SEQ ID NO: 42659 - protein, 291 aa, Staphylococcus epidermidis VCU041; identical to SEQ ID NO: 39372

SEQ ID NO: 42660 - protein, 3692 aa, Staphylococcus epidermidis VCU041; identical to SEQ ID NO: 42135

SEQ ID NO: 42661 - protein, 172 aa, Staphylococcus epidermidis VCU041; identical to SEQ ID NO: 30248

SEQ ID NO: 42662 - protein, 688 aa, Staphylococcus epidermidis VCU041
MKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTAQQEDSQKENLSKQDTQSSKTTDLLRATGQNQSKDSQSTEEVNKEVKNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSSLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42663 - protein, 92 aa, Staphylococcus epidermidis VCU041
SDSDSDADSDSDSDSDSDADSDSDADSDSDADSDSDADRDHNDKTDKPNNKELPDTGNDAQNNGTLFGSLFAALGGLFLVGRRRKNKNNEEK

SEQ ID NO: 42664 - protein, 219 aa, Staphylococcus epidermidis VCU041; identical to SEQ ID NO: 39379

SEQ ID NO: 42665 - protein, 427 aa, Staphylococcus epidermidis VCU041
MINKKNNLLTKKKPIANKSNKYAIRKFTVGTASIVIGATLLFGLGHNEAKAEENSVQDVKDSNTDDELSDSNDQSSDEEKNDVINNNQSINTDDNNQIIKKEETNNYDGIEKRSEDRTESTTNVDENEATFLQKTPQDNTHLTEEEVKESSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQ

SEQ ID NO: 42666 - protein, 681 aa, Staphylococcus epidermidis VCU041
MLKKKLDFLPNKLNKYSIRRFTVGTASILVGSTLLFGIGNEAHAAEEHQKSNTTENVADSNASEAPTKEEAPSNEATSEAPTKEEVPSNEATSEAPTKEEAPSNEATSEAPTKEEAPSNEATSEASTKEEAPAAEETDKATEEAPKTEETDKATKEEAPAVEETSKAATEEAPKAEETDKATEEAPKTEETSKAATEKAPKAEETNKVETEEAPAAEETNKAATEETPAVEDTNAKSNSNAQPSETERTQVVDTVAKDLYKKSEVTEAEKAEIEKVLPKDISNLSNEEIKKIALSEVLKETANKENAQPRATFRSVSSNARTTNVNYSATALRAAAQDTVTKKGTGNFTAHGDIIHKTYKEEFPNEGKLTAFNTNFNPDTGTKGALEYNDKIDFNKDFTITVPVANNNQGNTTGADGWGFMFTQGNGQDFLNQGGILRDKGMANASGFKIDTAYNNVNGKVDKLDADKTNNLSQIGAAKVGYGTFVKNGADGVTNQVGQNALNTKDKPVNKIIYADNTTNHLDGQFHGQRLNDVVLNYDAATSTITATYAGKTWKATTDDLGIDKSQKYNFLITSSHMQNRYSNGIMRTNLEGVTITTPQADLIDDVEVTKQPIPHKTIREFDPTLEPGSPDVIVQKGEDGEKTTTTPTKVDPDTGDVVERGEPTTEVTKNPVDEIVHFAP

SEQ ID NO: 42667 - protein, 327 aa, Staphylococcus epidermidis VCU041; identical to SEQ ID NO: 42156

SEQ ID NO: 42668 - protein, 681 aa, Staphylococcus epidermidis VCU041; identical to SEQ ID NO: 42118

SEQ ID NO: 42669 - protein, 728 aa, Staphylococcus epidermidis VCU041; identical to SEQ ID NO: 39721

SEQ ID NO: 42670 - protein, 293 aa, Staphylococcus epidermidis VCU041
SITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGTPAEPGKPAEPGTPAEPGTPAQSGAPEQPNRSMHSTDNKNQLPDTGENRQANEGTLVGSLLAIVGSLFIFGRRKKGNEK

SEQ ID NO: 42671 - protein, 404 aa, Staphylococcus epidermidis VCU041; identical to SEQ ID NO: 42229

SEQ ID NO: 42672 - protein, 434 aa, Staphylococcus epidermidis VCU041; identical to SEQ ID NO: 39380

SEQ ID NO: 42673 - protein, 205 aa, Staphylococcus epidermidis VCU041; identical to SEQ ID NO: 39382

SEQ ID NO: 42674 - protein, 172 aa, Staphylococcus epidermidis VCU041
SDSDSDSDSDSDSDSDADSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 42675 - protein, 235 aa, Staphylococcus epidermidis VCU041; identical to SEQ ID NO: 41955

SEQ ID NO: 42676 - protein, 343 aa, Staphylococcus epidermidis VCU041; identical to SEQ ID NO: 39377

SEQ ID NO: 42677 - protein, 99 aa, Staphylococcus epidermidis VCU041
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEGG

SEQ ID NO: 42678 - protein, 67 aa, Staphylococcus epidermidis VCU045
MLKKKLDFIPNKLNKFSIRRFTVGTASILVGSTLLFGIGNEAHAAEKNQELNTTANVADSDVGEAPS

SEQ ID NO: 42679 - protein, 1432 aa, Staphylococcus epidermidis VCU045
MKNKQGFLPNLLNKYGIRKLSAGTASLLIGATLVFGINGQVKAAETDNIVSQNGDNKTNDSESSDKELVKSKDDKTSSTSTDTNLESEFDQNNKPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLLNDANHQTTDEVNHSDSDNMTNSTPNDTENELDTTQLTSHDESPSPQSDNFTGFTNLMATPLNLRNDNPRINLLAATEDTKPKTYIKPNNSEYSYLLNDLGYDATTVKENSDLRHAGISQSQDNTGSVIKLNLTKWLSLQSDFVNGGKVNLSFAQSDFYTQIESITLRGVKMDTTNNGQNWSAPINGSTVNSGLIGSVTNHEILITLKNSQTLSSLGYSNNKLVYLTHTWTTNDGAIAEESIQVASITPTLDSKAPNTTQESGFTAGRVINKIKYDSSQKSIKSVHTFKPNENFLQTDYRAVLYIKEQVNKELIPYIDPNSVKLYVSDPDGNPISQDRYVNGSIDNDGLFDSSKINEISIKNNNTSGQLNNARTSLDRNVFFGPLGQSRSYTISYKLKDGYTLESIASKVSARETFDSWMEVDYLDSYDSGTPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNVTETIFTIDVEDTTKPTVESIAGQTQEVNTEIEPIKIEAKDNSGQTVTNKVDGLPDGVTFDEATNTISGTPSEVGSYTVTVTTMDESGNATETTFTIDVEDTTKPTVESVADQTQEVNTEITPITIESEDNSDQAVTNKVDGLPDGVTFDEATNTISGTPSEVGSYTVTVTTTDESGNATETTFTIDVEDTTKPTVKSVSDQTQEVNTEITPIKIEATDNSGQTVTNKVDGLPDGITFDEATNTISGTPSEVGSYDITVTTTDESGNATETTFTINVEDTTKPTVEDIADQTQEVNTEIEPIKIEATDNGGQAVTNKVDGLPDGVTFDEATNTISGTPSEVGSYDIIVTTTDENGNSETTTFTIDVEDTTKPTVEDIADQTQEINTEIEPIKIEARDNSGQAVTNKVEGLPAGITFDEATNTISGTPSEVGSYTVTVTTTDENGNATETTFTIDVEDTTKPTVEDITDQTQEINTEINPIKIETTDNSGQTVTNKVEGLPDGVTFDEATNTISGTPSEVGS

SEQ ID NO: 42680 - protein, 254 aa, Staphylococcus epidermidis VCU045
VHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPAEPGKPAESGKPVEPGKPVEPGTPAQSGAPEQPNRSMHSTDNKNQLPDTGENRQANEGTLVGSLLAIVGSLFIFGRRKKGNEK

SEQ ID NO: 42681 - protein, 434 aa, Staphylococcus epidermidis VCU045; identical to SEQ ID NO: 39380

SEQ ID NO: 42682 - protein, 1036 aa, Staphylococcus epidermidis VCU045
MFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQKPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDSDSDSDNDSDLGNSSDKSTKDKLPDTGANEDYGSKGTLLGTLFAGLGALLLGKRRKNRKNKN

SEQ ID NO: 42683 - protein, 94 aa, Staphylococcus epidermidis VCU045; identical to SEQ ID NO: 42021

SEQ ID NO: 42684 - protein, 688 aa, Staphylococcus epidermidis VCU045; identical to SEQ ID NO: 41949

SEQ ID NO: 42685 - protein, 3692 aa, Staphylococcus epidermidis VCU045; identical to SEQ ID NO: 42099

SEQ ID NO: 42686 - protein, 47 aa, Staphylococcus epidermidis VCU045
ESGSESHSNSELPDTGEEDNHQGLIGGVLAAFGGLTLLGRRRKKEEK

SEQ ID NO: 42687 - protein, 205 aa, Staphylococcus epidermidis VCU045; identical to SEQ ID NO: 39382

SEQ ID NO: 42688 - protein, 1330 aa, Staphylococcus epidermidis VCU045
MFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEYTTTKLKTPSISTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNLGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSGQDITVDSNGITTTGVINGADNLTIDSGFYKTPKYSVGDYVWKDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDADSDSDSDSDSDADSDSDADSDSDSDSDSDSDSDSDSDSDSDSDSDSDSDSDSDSDSDSDSDSDSDSDSDSDSDADSDSDSDSDSDADSDSDADSDSDSDSDSDADSDSDSDSDSDSDSDSDADSDSDSDSDSDADSDSDSDSDSDSDSDSDSDSDSDSDSDSDSDKNAKDKLPDTGANEDHDSKGTLLGALFAGLGALLLGRRRKKDNKEK

SEQ ID NO: 42689 - protein, 681 aa, Staphylococcus epidermidis VCU045; identical to SEQ ID NO: 42118

SEQ ID NO: 42690 - protein, 327 aa, Staphylococcus epidermidis VCU045; identical to SEQ ID NO: 42127

SEQ ID NO: 42691 - protein, 728 aa, Staphylococcus epidermidis VCU045
MKNKKNSYSIRKLSVGASSIIVASMLFIGGGSVHAAESNHLENQEQSEISASHSIEMQHKNQETQQTENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGNRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42692 - protein, 436 aa, Staphylococcus epidermidis VCU045
YTVTVTTTDENGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPTINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42693 - protein, 3295 aa, Staphylococcus epidermidis VCU045
MNNRDKLQKFSIRKYAIGTFSTVIATLVFMGINTNHASADELNQNQKLIKQLNQTDDDDSNTHSQEIENNKQNSSGKTESLRSSTSQNQANARLSDQFKDTNETSQQLPTNVSDDSINQSHSEANMNNEPLKVDNSTMQAHSKIVSDSDGNASENKHHKLTENVLAESRASKNDKEKENLQEKDKSQQVHPPLDKNALQAFFDASYHNYRMIDRDRADATEYQKVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYSDENFALLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSIDSVYDPLSYVKNVTGTVLGIYPSYLPYNQERWQGANAMNAYQIEELFSQENLQNAARSGRPIQFLVGFDVEDSHHNPETLLPVNLYVKPELKHTIELYHDNEKQNRKEFSVSKRAGHGVFQIMSGTLHNTVGSGILPYQQEIRIKLTSNEPIKDSEWSITGYPNTLTLQNAVGRTNNATEKNLALVGHIDPGNYFITVKFGDKVEQFEIRSKPTPPRIITTANELRGNSNHKPEIRVTDIPNDTTAKIKLVMGGTDGDHDPEINPYTVPENYTVVAEAYHDNDPSKNGVLIFRSSDYLKDLPLSGELKAIVYYNQYVQSNFSNSVPFSSDTTPPTINEPAGLVHKYYRGDHVEITLPVTDNTGGSGLRDVNVNLPQGWTKTFTINPNNNTEGTLKLIGNIPSNEAYNTTYHFNITATDNSGNTTNPAKTFILNVGKLADDLNPVGLSRDQLQLVTDPSSLSNSEREEVKRKISEANANIRSYLLQNNPILAGVNGDVTFYYRDGSVDVIDAENVITYEPERKSIFSENGNTNKKEAVITIARGQNYTIGPNLRKYFSLSNGSDLPNRDFTSISAIGSLPSSSEISRLNVGNYNYRVNAKNAYHKTQQELNLKLKIVEVNAPTGNNRVYRVSTYNLTNDEINKIKQAFKAANSGLNLNDNDITVSNNFDHRNVSSVTVTIRKGDLIKEFSSNLNNMNFLRWVNIRDDYTISWTSSKIQGRNTDGGLEWSPDHKSLIYKYDATLGRQINTNDVLTLLQATAKNSNLRSNINSNEKQLAERGSNGYSKSIIRDDGEKSYLLNSNPIQVLDLVEPDNGYGGRQVSHSNVIYNEKNSSIVNGQVPEANGASAFNIDKVVKANAANNGIMGVIYKAQLYLAPYSPKGYIEKLGQNLSNTNNVINVYFVPSDKVNPSITVGNYDHHTVYSGETFKNTINVNDNYGLNTVASTSDSAITMTRNNNELVGQAPNVTNSTNKIVKVKATDKSGNESIVSFTVNIKPLNEKYRITTSSSNQTPVRISNIQNNANLSIEDQNRVKSSLSMTKILGTRNYVNESNNDVRSQVVSKVNRSGNNATVNVTTTFSDGTTNTITVPVKHVLLEVVPTTRTTVRGQQFPTGKGTSPNDFFSLRTGGPVDARIVWVNNQGPDINSNQIGRDLTLHAEIFFDGETTPIRKDTTYKLSQSIPKQIYETTINGRFNSSGDAYPGNFVQAVNQYWPEHMDFRWAQGSGTPSSRNAGSFTKTVTVVYQNGQTENVNVLFKVKPNKPVIDSNSVISKGQLNGQQILVRNVPQNAQVTLYQSNGTVIPNTNTTIDSNGIATVTIQGTLPTGNITAKTSMTNNVTYTKQNSSGIASNTTEDISVFSENSDQVNVTAGMQAKNDGIKIIKGTNYNFNDFNSFISNIPAHSTLTWNEEPNSWKNNIGTTTKTVTVTLPNHQGTRTVDIPITIYPTVTAKNPVRDQKGRNLTNGTDVYNYIIFENNNRLGGTASWKDNRQPDKNIAGVQNLIALVNYPGISTPLEVPVKVWVYNFDFTQPIYKIQVGDTFPKGTWAGYYKHLENGEGLPIDGWKFYWNQQSTGTTSDQWQSLAYTRTPFVKTGTYDVVNPSNWGVWQTSQSAKFIVTNAKPNQPTITQSKTGDVTVTPGAVRNILISGTNDYIQASADKIVINKNGNKLTTFVKNNDGRWTVETGSPDINGIGPTNNGTAISLSRLAVRPGDSIEAIATEGSGETISTSATSEIYIVKAPQPEQVATHTYDNGTFDILPDNSRNSLNPTERVEINYTEKLNGNETQKSFTITKNNNGKWTINNKPNYVEFNQDNGKVVFSANTIKPNSQITITPKAGQGNTENTNPTVIQAPAQHTLTINEIVKEQGQNVTNDDINNAVQVPNKNRVAIKQGNALPTNLAGGSTSHIPVVIYYSDGSSEEATETVRTKVNKTELINARRRLDEEISKENKTPSSIRNFDQAMNRAQSQINTAKSDADQVIGTEFATPQQVNSALSKVQAAQNKINEAKALLQNKADNSQLVRAKEQLQQSIQPAASTDGMTQDSTRNYKNKRQAAEQAIQHANSVINNGDATSQQINDAKNTVEQAQRDYVEAKSNLRADKSQLQSAYDTLNRDVLTNDKKPASVRRYNEAISNIRKELDTAKADASSTLRNTNPSVEQVRDALNKINTVQPKVNQAIALLQPKENNSELVQAKKRLQDAVNDIPQTQGMTQQTINNYNDKQREAERALTSAQRVIDNGDATTQEITSEKSKVEQAMQALTNAKSNLRADKNELQTAYNKLIENVSTNGKKPASIRQYETAKARIQNQINDAKNEAERILGNDNPQVSQVTQALNKIKAIQPKLTEAINMLQNKENNTELVNAKNRLENAVNDTDPTHGMTQETINNYNAKKREAQNEIQKANMIINNGDATAQDISSEKSKVEQVLQALQNAKNDLRADKRELQTAYNKLIQNVNTNGKKPSSIQNYKSARRNIENQYNTAKNEAHNVLENTNPTVNAVEDALRKINAIQPEVTKAINILQDKEDNSELVRAKEKLDQAINSQPSLNGMTQESINNYTTKRREAQNIASSADTIINNGDASIEQITENKIRVEEATNALNEAKQHLTADTTSLKTEVRKLSRRGDTNNKKPSSVSAYNNTIHSLQSEITQTENRANTIINKPIRSVEEVNNALHEVNQLNQRLTDTINLLQPLANKESLKEARNRL

SEQ ID NO: 42694 - protein, 291 aa, Staphylococcus epidermidis VCU045; identical to SEQ ID NO: 39372

SEQ ID NO: 42695 - protein, 235 aa, Staphylococcus epidermidis VCU045; identical to SEQ ID NO: 41955

SEQ ID NO: 42696 - protein, 319 aa, Staphylococcus epidermidis VCU045; identical to SEQ ID NO: 42111

SEQ ID NO: 42697 - protein, 827 aa, Staphylococcus epidermidis VCU045; identical to SEQ ID NO: 42123

SEQ ID NO: 42698 - protein, 219 aa, Staphylococcus epidermidis VCU045; identical to SEQ ID NO: 39379

SEQ ID NO: 42699 - protein, 2229 aa, Staphylococcus epidermidis VCU057
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKIILEQKGNEKKSAIAQTPDATTEEKQEAVSAVSQAVTNGITHINQANSNDDVDQELSNAEQIITQTNVNVQKKPQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKSDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKIIY

SEQ ID NO: 42700 - protein, 291 aa, Staphylococcus epidermidis VCU057; identical to SEQ ID NO: 41958

SEQ ID NO: 42701 - protein, 1016 aa, Staphylococcus epidermidis VCU057
MFGLGHNEAKAEENSVQDVKDSNTDDELSDSNDQSSDEEKNDVINNNQSINTDDNNQIIKKEETNNYDGIEKRSEDRTESTTNVDENEATFLQKTPQDNTHLTEEEVKESSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDLGNSSDKSTKDKLPDTGANEDYGSKGTLLGTLFAGLGALLLGKRRKNRKNKN

SEQ ID NO: 42702 - protein, 701 aa, Staphylococcus epidermidis VCU057; identical to SEQ ID NO: 41969

SEQ ID NO: 42703 - protein, 434 aa, Staphylococcus epidermidis VCU057; identical to SEQ ID NO: 39380

SEQ ID NO: 42704 - protein, 448 aa, Staphylococcus epidermidis VCU057
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKLATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDA

SEQ ID NO: 42705 - protein, 688 aa, Staphylococcus epidermidis VCU057; identical to SEQ ID NO: 41949

SEQ ID NO: 42706 - protein, 205 aa, Staphylococcus epidermidis VCU057; identical to SEQ ID NO: 39382

SEQ ID NO: 42707 - protein, 190 aa, Staphylococcus epidermidis VCU057; identical to SEQ ID NO: 30534

SEQ ID NO: 42708 - protein, 219 aa, Staphylococcus epidermidis VCU057; identical to SEQ ID NO: 39379

SEQ ID NO: 42709 - protein, 404 aa, Staphylococcus epidermidis VCU057; identical to SEQ ID NO: 42229

SEQ ID NO: 42710 - protein, 235 aa, Staphylococcus epidermidis VCU057; identical to SEQ ID NO: 41955

SEQ ID NO: 42711 - protein, 225 aa, Staphylococcus epidermidis VCU057; identical to SEQ ID NO: 39376

SEQ ID NO: 42712 - protein, 74 aa, Staphylococcus epidermidis VCU057
GTPAEPGKPAEPGTPTQSGAPEQPNRSMHSTDNKNQLPDTGENRQANEGTLVGSLLAIVGSLFIFGRRKKGNEK

SEQ ID NO: 42713 - protein, 327 aa, Staphylococcus epidermidis VCU057; identical to SEQ ID NO: 42020

SEQ ID NO: 42714 - protein, 681 aa, Staphylococcus epidermidis VCU057; identical to SEQ ID NO: 41966

SEQ ID NO: 42715 - protein, 98 aa, Staphylococcus epidermidis VCU057
MGKRRQGPINKKVDFLPNKLNKYSIRKFTVGTASILLGSTLIFGSSSHEAKAAEEKQVDPITQANQNDSSERSLENTNQPTVNNEAPQMSSTLQAEEG

SEQ ID NO: 42716 - protein, 688 aa, Staphylococcus epidermidis VCU065; identical to SEQ ID NO: 41949

SEQ ID NO: 42717 - protein, 434 aa, Staphylococcus epidermidis VCU065; identical to SEQ ID NO: 39380

SEQ ID NO: 42718 - protein, 327 aa, Staphylococcus epidermidis VCU065; identical to SEQ ID NO: 42020

SEQ ID NO: 42719 - protein, 366 aa, Staphylococcus epidermidis VCU065
MKDNKPNNSKLIQTYLSKKTLRYGTASALTLALYLFNSNVTVYADENTANQNQGTSPKTSQTAPTNNNENTDATAVTTDQNNNDEEEYDASYEIPILYVTVWLDDQGNIIKDAVEDAKTPASERQPVKIPGYQHYRTSVSDGITKFIYRKISTAQSPIVENNQQDNTNKVVETTNQNKDEVNGKEQNQANTSVTNTQITKNEKDEDTKILQKDEDTKLLQKDKDEKESKDAKTPKKDKKEKITKTPKKDREKKSPVIPKSGKDEKESKDRKTPKKDKKEKITKTPKKDREEKKPVIPKTGKDEKDTKITKKDNEDEITTTSKKDNNNDIQDKLPETGKSNDIQNPALIMLLAGLGLLGLFRNKIRE

SEQ ID NO: 42720 - protein, 1150 aa, Staphylococcus epidermidis VCU065
MKKRRQGPINKRVDFLSNKVNKYSIRKFTVGTASILVGATLMFGAADNEAKAAEDNQLESASKEEQKGSRDNESSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSISTDSSVNDKQDYTRSAVASLGVDSNETEAITNAVRDNLDLKAASREQINEAIIAEALKKDFSNPDYGVDTPLALNTSQSKNSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFTPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISNVKVTLKNKNGDTIGTTTTDSNGKYEFTGLENGDYTIEFETPEGYTPTKQNSGSDEGKDSNGTKTTVTVKDADNKTIDSGFYKPIYNLGDYVWEDTNKDGIQDDSEKGISGVKVTLKDKNGNAIGTTTTDASGHYQFKGLENGSYTVEFETPSGYTPTKANSGQDITVDSNGITTTGIINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADS

SEQ ID NO: 42721 - protein, 681 aa, Staphylococcus epidermidis VCU065; identical to SEQ ID NO: 41966

SEQ ID NO: 42722 - protein, 205 aa, Staphylococcus epidermidis VCU065; identical to SEQ ID NO: 39382

SEQ ID NO: 42723 - protein, 728 aa, Staphylococcus epidermidis VCU065; identical to SEQ ID NO: 39721

SEQ ID NO: 42724 - protein, 259 aa, Staphylococcus epidermidis VCU065
PTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGTPTQSGAPEQPNRSMHSTDNKNQLPDTGENRQANEGTLVGSLLAIVGSLFIFGRRKKGNEK

SEQ ID NO: 42725 - protein, 291 aa, Staphylococcus epidermidis VCU065; identical to SEQ ID NO: 39372

SEQ ID NO: 42726 - protein, 219 aa, Staphylococcus epidermidis VCU065; identical to SEQ ID NO: 39379

SEQ ID NO: 42727 - protein, 872 aa, Staphylococcus epidermidis VCU065
MINKKNNLLTKKKPIANKSNKYAIRKFTVGTASIVIGATLLFGLGHNEAKAEENSVQDVKDSNTDDELSDSNDQSSDEEKNDVINNNQSINTDDNNQIIKKEETNNYDGIEKRSEDRTESTTNVDENEATFLQKTPQDNTHLTEEEVKESSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSD

SEQ ID NO: 42728 - protein, 619 aa, Staphylococcus epidermidis VCU065
MNNRDKLQKFSIRKYAIGTFSTVIATLVFMGINTNHASADELNQNQKLIKQLNQTDDDDSNTHSQEIENNKQNSSGKTESLRSSTSQNQANARLSDQFKDTNETSQQLPTNVSDDSINQSHSEANMNNEPLKVDNSTMQAHSKIVSDSDGNASENKHHKLTENVLAESRASKNDKEKENLQEKDKSQQVHPPLDKNALQAFFDASYHNYRMIDRDRADATEYQKVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYGDENFALLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSIDSVYDPLSYVKNVTGTVLGIYPSYLPYNQER

SEQ ID NO: 42729 - protein, 827 aa, Staphylococcus epidermidis VCU065; identical to SEQ ID NO: 41959

SEQ ID NO: 42730 - protein, 190 aa, Staphylococcus epidermidis VCU065; identical to SEQ ID NO: 30534

SEQ ID NO: 42731 - protein, 86 aa, Staphylococcus epidermidis VCU065
MDFLPNKLNKYSIRKFTVGTASILLGSTLIFGSSSHEAKAAEEKQVDPITQANQNDSSERSLENTNQPTVNNEAPQMSSTLQAEEG

SEQ ID NO: 42732 - protein, 3692 aa, Staphylococcus epidermidis VCU065
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATTEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSVINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42733 - protein, 235 aa, Staphylococcus epidermidis VCU065; identical to SEQ ID NO: 41955

SEQ ID NO: 42734 - protein, 292 aa, Staphylococcus epidermidis VCU071
MKKSSKFSKDFPTRKNHYAIRKFTVGTASIIVGSFLFFGQTQAQAEEFERVTTGTVDTGGQPARADQGQEGPQAGADTHNTASQPGVTGQDAPNENHAGDQNAAVTHPADQENNAPQVGAGTPGAENTPQADGENHNQENAVTSAGTNGEQNSGKPATSTTDQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTD

SEQ ID NO: 42735 - protein, 688 aa, Staphylococcus epidermidis VCU071
MKTRQNKYSIRKFSVGASSILIAALLFMGGGSAQAAEQQQDKGTVENSTTQSIGDENEKLSEQQSTQNKNVNEKSNVNSITENESLHNETPKNEDLIQQQKDSQNDNKSESVVEQNKENEAFVQNHSEEKPQQEQVELEKHASENNQTLHSKAAQSNEDVKTKPSQLDNTTAQQEDSQKENLSKQDTQSSKTTDLLRATGQNQSKDSQSTEEVNKEVNNDTQQVTAKNDDDKVETFNLNSKEEPLKVDKQANPTTDKDKSSKNDKGSHDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGDHDNMVSSITTLGTPHNGTHASDLLGNEAIVRQLAYDVGKMYGNKDSRVDFGLEHWGLKQKPNESYMQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42736 - protein, 728 aa, Staphylococcus epidermidis VCU071
MKNKKNSYSIRKLSVGASSIIVASMLFIGGGSVHAAESNHLENQEQSEVSASHSIEMQHKNQETQQPENKDNKTNHSETIDKTPTIHSNGYSYHETPSTDVKSNEGKQIDSQSNQPQTSMPKNDQQNPKKVAEHATKSINAKKEETRKNENAKSLVQPQQDDKTTSEQTKMKESREQEITNEQKQLQSKDIKNAQQENQNIDQEKSQEKIKVQQSNIEKAQKSSRIDGKLDNQYNKDATQSNEGTVSENVSEQHITANDAGVTRNNRGDERLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGDRLKIIQDYRAKGYNVMEASISAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQRDDETLVQYIQRVKQSKLWTTKDNGFYDLTTEGTDILNQKTSLNPNIVYKTYQGESTRPGANGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42737 - protein, 190 aa, Staphylococcus epidermidis VCU071
MKKVLALLFASTLILGACGDKNDESKNDSSSNSTDSVSVDKNDNEDKTTAKFKNDKLTTDNFDIEILEAKTVKASKYDDDKKPSIAIIYGVKNKKDKDLTASSAFIKSFDIYQNSKDVKRKLEIGGGFDTDLKEKYEEDMDNQINKDGKVKGVMFFKLKDTKTPVTLEAKDPNNGNDEKVGTKEFKIKEN

SEQ ID NO: 42738 - protein, 544 aa, Staphylococcus epidermidis VCU071
MPADSSSNNTKNTIDIPPTMVKGRDNYDFYGRVDIQSNPTDLNATNLTRYNYGQPSGTTTAGAVQFKNQVSFDKDFDFNIRVANNHQSNTTGADGWGFMFSKKDGDDFLKNGGILREKGTPSAAGFRIDTGYYNNDPLDKKENQAGQGYRGYGTFVKNDSQGNTSKVGSGTPSTDFLNYADNTTNDLDGKFHGQKLNNVNLKYNASNQTFTATYAGKTWTATLSELGLSPTDSYNFLVTSSQYGNGNSGTYADGVMRADLDGATLTYTPKAVDGDPITSTKEIPFNKKREFDPNLAPGTEKVVQKGEPGIETTTTPTYVNPNTGEKVGEGTPTTKITKQPVDEIVHYGGEEIKPGHKDEFDPNAPVDSKTEVPGKPGVKNPDTGEVVTPPVDDVTKYGPKVGNPITSTEEIPYDKKRVFNPDLKPGEERVKQKGEPGTKTITTPILVNPITGEKVGEGKSTEKVTKQPVDEIVEYGPTKAEPDTPAQSGAPEQPNRLMHSTDNKNQLPDTGENRQANEGTLVGSLLAIVGSLFIFGRRKKGNEK

SEQ ID NO: 42739 - protein, 327 aa, Staphylococcus epidermidis VCU071
MNWQRKCILTTLLVLSSLFLVFSTITYASERDSKDSLKITTHNVYFLPTAIYPNWGQSQRADLISKADYIQDQDVVILNELFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMNEIKQFIKDKNIPKNEPVYIGGDLNVIKDSDEYQQMANNLNVSLPTQFDGNAYSWDTSSNSIAKYNYPKLEPQHLDYILLDRDHAQPSSWHNETHRVKSPEWSVKSWGKTYKYNDYSDHYPLSGYASNE

SEQ ID NO: 42740 - protein, 681 aa, Staphylococcus epidermidis VCU071
MTNNNRIKRFSIRKYAVGVVSIITGVTIFIGGQQAQAAETSVQHADAHPEDSQTTQQLKNDKVEETLKASKQGTADSQQVQTIDQSKTNQNNQHSVAESAQLKSDETANQPKKEEGSSVKQDVQPSKNVNQQDVATQSNERENNDITGEGQTSKASNQHTQSSNSHNQSTGTKDSDSEEIDQPLVKLQKPSNDSTYQTQSKAKQDSSKQLPQEKTTKRQIQTTENEQTTKVDSKKANDTQDVEKHTQEPKNDTSTSQKNHHQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQRPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42741 - protein, 801 aa, Staphylococcus epidermidis VCU071
MKKRRQGPINKRVDFLSNKVNKYSIRKFTVGTASILVGATLMFGAADNEAKAAEDNQLESASKEEQKGSRDNESSKLNQVDLDNGSHSSEETTNVNNATEVKKVEAPTTSDVSNPKANEAVVTNESTKPKTTEAPTVNEESIAETPKTSTTQQDSTEKNNPSLKDNLNSSSTTSKESKTDEHSTKQAQMSTNKSNLDTKDSPTQSEKTSSQANNDSTDNQSAPSKQLDSKSSEQKVYKTKFNDEPTQDVEHTATKLKTPSISTDSSVNDKQDYTRSAVASLGVDSNETEAITNAVRDNLDLKTASREQINEAIIAEALKKDFSNPDYGVDTPLALNTSQSKTSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQSYPMEVTIADEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFAPKVSADGTRVDINFASSMANGKKYIVTQAVRPTGTGNVYTEYWLTRDGTTNTNDFYRGTKSTTVSYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNV

SEQ ID NO: 42742 - protein, 210 aa, Staphylococcus epidermidis VCU071
MNNRDKLQKFSIRKYAIGTFSTVIATLVFMGINTNHASADELNQNQKLIKQLNQTDDDDSNTHSQEIENNKQNSGGQTEPLRSSTSQNQANARLSDQIKDTNETSQQLPTNVSDDSINQSHSEANMNNEPLKVDNSTMQAHSKIVSDSDGNASENEHHKLTENVLAESRASKNDKEKENLQEKDKSQQVQPPLDKNALQAFSTHHITITE

SEQ ID NO: 42743 - protein, 292 aa, Staphylococcus epidermidis VCU071
DEKGNIISTTTTDENGKYQFDNLDSGNYIIHFEKPEGMTQTTANSGNDDEKDADGEDVRVTITDHDDFSIDNGYFDDDSDSDSDSDSDSDSDSDSDSDSDSDSDSDSDSDSDSDSDADSDSDSDSDSDSDSDSDSDSDSDSDSDSDSDSDSDSDSDSDSDSDSDSDSNSDSDSDSDADSDSDSDSDADSDSDADSDSDSDSDSDSDSDSDSDSDSDSDSDADSDSDSDSDSDSDSDSDSDSDSDSDKNAKDKLPDTGANEDHGSKGTLLGTLFAGLGALLLGRRRKKDNKEK

SEQ ID NO: 42744 - protein, 434 aa, Staphylococcus epidermidis VCU071; identical to SEQ ID NO: 39380

SEQ ID NO: 42745 - protein, 291 aa, Staphylococcus epidermidis VCU071; identical to SEQ ID NO: 41958

SEQ ID NO: 42746 - protein, 952 aa, Staphylococcus epidermidis VCU071
MFGLGHNEAKAEENSVQDVKDSNTDDELSDSNDQSSDEEKNDVINNNQSINTDENNQINKKEETNSNDGIEKRSEDRTQSTTNVDENEATFLQKTPQDNTHLTEEEVKEPSSVESSNSSIDTAQQPSHTTINREESVQTSDNVEDSHVSDFANSKIKESNTESGKEETTIEQPNKVREDSITSQPSGYKNIDEKISNQDELLNLPINEYENKARPLSTTSAQPSIKRVTVNQLAAEQGSNVNHLIKVTDQSITEGYDDSEGIIKAHDAENLIYDVTFEVDNKVKSGDTMTVDIDKNTVPSDLTDSFTIPKIKDNSGEIIATGTYDNKNKQITYTFTDYVDKYENIKAHLKLTSYIDKSKVPNNNTKLDLEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSKYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDLGNSSDKSTKDKLPDTGANEDYDSKGTLLGTLFAGLGALLLGKRRKNRKNKN

SEQ ID NO: 42747 - protein, 321 aa, Staphylococcus epidermidis VCU071
MKDNKPNNSKLIQTYLSKKTLRYGTASALTLALYLFNSNVTVYADENTANQNQGTSPKTSQTAPTNNNENTDATAVTTDQNNNDEEEYDASYELPILYVTVWLDDQGNIIKDAVEDAKTPASERQPVKIPGYQHYRTSMSDGITKFIYRKISTAQSSIVENNQQDNNTNKVVETTNQNKDEVNGKEQNQANTSVTNTQITKNEKDKDTKTLQKDKDEKESKDIKTPKKDKKEKITKTPKKDREEKKPVIPSNGKDEKDEDTKITKKDKEDKITTTSKKDNNNDIQDKLPETGKSNDIQNPALIMLLAGLGLLGLFRNKIRE

SEQ ID NO: 42748 - protein, 219 aa, Staphylococcus epidermidis VCU071; identical to SEQ ID NO: 42051

SEQ ID NO: 42749 - protein, 3692 aa, Staphylococcus epidermidis VCU071
MNLFRKQKFSIRKFNIGIFSALIATVAFLAHPGQATASELEPSQNNDTTAQSDGGLENTSQSNPISEETTNTLSGQTVPSSTENKQTQNDPNHNAQPIARNTEEAESAQTALYTNINENNGTSDDGLHVNQPAKHHIEAQSENVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHILTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIANINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIDKTNEKQSAINTDNEGTIEEKQKAIQSLNDAKNLADEQITQAASNQNVDNALNIGINNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQTINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKNIKDDAITSLSRINAQVAEKESARNAIEQKATQQTQFINNNDNTTDEEKEVANNLVIATKQKSLDNINSLSSNSDVENAKVAGINEIANVLPATAVKSQAKKDIDQKLAQQINQIQTHQTATTEEKEAAIQLANQKSNEARTAIQNEHSNNGVAQAKSNGIHEIELVTPDAHKKSDAKQSIDDKFNEQTNTINTTPDATDEEKQKALDKLKIAKDAGYNKVDQAQTNQQVSDAKTEAIDTITNIQANVAKKPSARVELDSKFEDLKSQINATPNATEEEKQEAIQRLNGKRDEVKNLINQDRRDNDVEQHKNIGLQELETIHANPTRKSEALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVENAKTEAKSNITNSDTEREVNSAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEVAKQLVTQKLNEQIQKIHESTQDNQVDNVKAQAISAIKLINANAHKRQDAINILTNLAESKKSDIRANQDATTEEKNTAIQSIDDTLAQARNNINGANTNVLVDENLEDGKQKLQRIVLSTQTKTQAKADIAQAIGQQRSTIDQNQNATTEEKQEALERLNQDTNGVNDRIQAALANQNVTDEKNNILETIRNVEPIVAVKPKANEVIRKKAAEQTTLINQNQEATLEEKQIALGKLEEVKNEALNQVSQAHSNNDVKIAENNGIAKISEVHPETIIKRNAKQEIEQDAQSQIDTINANNKSTNEEKSAAIDRVNEAKIDAINNITNATTTQLVNDAKNSGNTSISQILPSTAVKTNALAALATEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSASDEIANVDHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQPHPQTKAIGRHKLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGVGTIRDIQPLVVKKPTAKSKIESAVEKKKTEINQTQNATHDEVREGLNQLNQIHEKAKNDVNQSQTNQQVENAEQNSLDQINNFRPDFSKKRNAVADIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPHVDTKAVARSVLNALAKQLIKTFENTADVTHEERNDAINHVKEQLSLVFNAIEKDRKDIQVAQDELFGLNELNSIFINITQKPTARKAISSMASQLNNSINNTPYATEEERQIALNKVKAIVDDANEKIREANTDSEVLGTKSNAITLLQAISADAQVKPQAFEEINAQAEIQRERINGNSDTTREEKEEALKQVDTLLNHSFITINNVNKNQEVYDTKNKTIEAIHKIKPISTIKPQALNEITIQLDAQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIATSEINKISVIAIKKPEAIAEIQELADKKLNKFKQNQEATIEEKQSAINELEQALKSAINHIHQSQNNESVSAALKESISLIDSIEIQAHKKLEAKAYIDGYSDDKINDISSRATNEEKQIFVSKLKALINRAHKQIDEAETFVSVDTIVRNFKVEVDKLNSIVRKKAKALKEIELEADHVKQMINANLSASTRVKQNARTLINEVVSNALSQLNKVTTNKEVDEIVNETIEKLKSIQLREDKILSSQRSSTSMTEKSNQCYSSENNTINSLPEAGNADKSLPLAGVTLISGLAIMSSRKKKKDKKVND

SEQ ID NO: 42750 - protein, 235 aa, Staphylococcus epidermidis VCU071
MKKTVIASTLAVSLGIAGYGLSGHEAHASETTNVDKAHLVDLAQHNPEELNAKPVQAGAYDIHFVDNGYQYNFTSNGSEWSWSYTVAGSDADYTESSSNQEVSANAQSSNTNVQAVSAPTSSESRSYSTSTTSYSAPSHNYSSHSSSVRLSNGNTAGSVGSYAATQMAARTGVSASTWEHIIARESNGQLHARNASGAAGLFQTMPGWGSTGSVNDQINAAYKAYKAQGLSAWGM

SEQ ID NO: 42751 - protein, 219 aa, Staphylococcus epidermidis VCU081; identical to SEQ ID NO: 39379

SEQ ID NO: 42752 - protein, 815 aa, Staphylococcus epidermidis VCU081
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTDQAGATVKPGTTPNQDAEVKPNTDQTATGTQGATGDQNAEQGNTEQNNQNAEQGNTGQEGSNLNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNLDQNNTPTNGQDGDHTGQGTQVKPNPDQTATGTQGATGDQNTQQGNTEQNNQNAEQGNTGGTDKDAKVNTNDDETKTDVKNDTELPETGLSNEYDYTTTVFGSIALISSLLLLRRQRKESK

SEQ ID NO: 42753 - protein, 235 aa, Staphylococcus epidermidis VCU081; identical to SEQ ID NO: 41955

SEQ ID NO: 42754 - protein, 3692 aa, Staphylococcus epidermidis VCU081
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDEYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGHATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42755 - protein, 291 aa, Staphylococcus epidermidis VCU081; identical to SEQ ID NO: 39372

SEQ ID NO: 42756 - protein, 343 aa, Staphylococcus epidermidis VCU081; identical to SEQ ID NO: 39377

SEQ ID NO: 42757 - protein, 86 aa, Staphylococcus epidermidis VCU081
MGKRRQGPINKKVDFLPNKLNKYSIRKFTVGTASILLGSTLIFGSSSHEAKAAEEKQVDPITQANQNDSSERSLENTNQPTVNNEA

SEQ ID NO: 42758 - protein, 92 aa, Staphylococcus epidermidis VCU081
SDSDSDSDSDSDSDSDSDSDADSDSDSDSDSDSDSDSDADSDSDSDKNAKDKLPDTGANEDHDSKGTLLGTLFAGLGALLLGRRRKKDNKEK

SEQ ID NO: 42759 - protein, 327 aa, Staphylococcus epidermidis VCU081; identical to SEQ ID NO: 42020

SEQ ID NO: 42760 - protein, 681 aa, Staphylococcus epidermidis VCU081; identical to SEQ ID NO: 42631

SEQ ID NO: 42761 - protein, 728 aa, Staphylococcus epidermidis VCU081; identical to SEQ ID NO: 42297

SEQ ID NO: 42762 - protein, 59 aa, Staphylococcus epidermidis VCU081
AQSGAPEQPNRSMHSTDNKNQLPDTGENRQANEGTLVGSLLAIVGSLFIFGRRKKGNEK

SEQ ID NO: 42763 - protein, 688 aa, Staphylococcus epidermidis VCU081; identical to SEQ ID NO: 39381

SEQ ID NO: 42764 - protein, 434 aa, Staphylococcus epidermidis VCU081; identical to SEQ ID NO: 39380

SEQ ID NO: 42765 - protein, 814 aa, Staphylococcus epidermidis VCU105
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQGTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAEPSAPGTTNQAGATVKPGTTPNQDAEVKPNTDQTATGTQGATGDQNAEQGNTEQNNQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDQTNQSTQDDNDNQNTQQGNTKQNNQNAEQGNTGGTDKDAKVNTNDDETKTDVKNDTELPETGLSNEYDYTTTVFGSIALISSLLLLRRQRKESK

SEQ ID NO: 42766 - protein, 235 aa, Staphylococcus epidermidis VCU105; identical to SEQ ID NO: 41955

SEQ ID NO: 42767 - protein, 688 aa, Staphylococcus epidermidis VCU105
MKTRQNKYSIRKFSVGASSILIAALLFMGGGSAQAAEQQQDKGTVENSTTQSIGDENEKLSEQQSTQNKNVNEKSNVDSITENESLHNETPKNEDLIQQQKDSQNDNKSESVVEQNKENEAFVKKHSEEKPQQEQVELEKHASENNQTLHSKAAQSNEDVKTKPSQLDNTTAQQEDSQKENLSKQDTQSSKTTDLLRATGQNQSKDSQSTEEVNKEVKNDTQQVTAKNDDDKVETFNLNSKEEPLKVDKQANPTTDKDKSSKNDKGSHDGLANLESNAVATTNKQFKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42768 - protein, 291 aa, Staphylococcus epidermidis VCU105; identical to SEQ ID NO: 41987

SEQ ID NO: 42769 - protein, 2869 aa, Staphylococcus epidermidis VCU105
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEKVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTSHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDAIDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVEGINEIANVLPATAVKSKAKKDIDQKLAQQINQIQTHQTATTEEKEAAIQLVNQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKA

SEQ ID NO: 42770 - protein, 870 aa, Staphylococcus epidermidis VCU105
MINKKNNLLTKKKPIANKSNKYAIRKFTVGTASIVIGATLLFGLGHNEAKAEENSVQDVKDSNTDDELSDSNDQSSDEEKNDVINNNQSINTDDNNQIIKKEETNNYDGIEKRSEDRTESTTNVDENEATFLQKTPQDNTHLTEEEVKESSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSD

SEQ ID NO: 42771 - protein, 434 aa, Staphylococcus epidermidis VCU105; identical to SEQ ID NO: 39380

SEQ ID NO: 42772 - protein, 728 aa, Staphylococcus epidermidis VCU105
MKNKKNSYSIRKLSVGASSIIVASMLFIGGGSVHAAESNHLENQEQSEVSASHSIEMQHKNQETQQTENKDNKTNHSETIDKTPTIHNNGYSYHETPSTDVKSNEDKQIDSQFNQPQTSMPNNDQQNPKKVAEHTTKSINAKKEETRKNENAKSLVQPQQDDKTTSEQTKMKESREQEITNEQKQIQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVDDIDKDLSTKESPENEKDDSRKGIKALTKNSQATTRNTATTEASKELKDQTNKVASQKEYKNHDPIILVHGFNGYASGTGPVTGKGNYWGGNRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHDGDISPLYKGGQDNMISSITTIATPHNGTHAADLLGNEEIIRQVAYDYARSKGNKLSHVDVGLSQWGLKQREDETLAQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42773 - protein, 327 aa, Staphylococcus epidermidis VCU105; identical to SEQ ID NO: 42020

SEQ ID NO: 42774 - protein, 681 aa, Staphylococcus epidermidis VCU105; identical to SEQ ID NO: 41996

SEQ ID NO: 42775 - protein, 219 aa, Staphylococcus epidermidis VCU105; identical to SEQ ID NO: 39379

SEQ ID NO: 42776 - protein, 291 aa, Staphylococcus epidermidis VCU109; identical to SEQ ID NO: 39372

SEQ ID NO: 42777 - protein, 327 aa, Staphylococcus epidermidis VCU109; identical to SEQ ID NO: 42020

SEQ ID NO: 42778 - protein, 681 aa, Staphylococcus epidermidis VCU109; identical to SEQ ID NO: 42027

SEQ ID NO: 42779 - protein, 96 aa, Staphylococcus epidermidis VCU109
MGKRRQGPINKKVDFLPNKLNKYSIRKFTVGTASILLGSTLIFGSSSHEAKAAEEKQVDPITQANQNDSSERSLENTNQPTVNNEAPQMSSTLQAE

SEQ ID NO: 42780 - protein, 161 aa, Staphylococcus epidermidis VCU109
DSDSDADSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDADSDSDSDKNAKDKLPDTGANEDHDSKGTLLGTLFAGLGALLLGRRRKKDNKEK

SEQ ID NO: 42781 - protein, 798 aa, Staphylococcus epidermidis VCU109
MKNKQGFLPNLLNKYGIRKLSAGTASLLIGATLVFGINGQVKAAETDNIVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLSNDANHQTTDEVNHSDSDNMTNSTPNDTENELDTTQLTSHDESPSPQSDNFTGFTNLMATPLNLRNDNPRINLLAATEDTKPKTYKKPNNSEYSYLLNDLGYDATTVKENSDLRHAGISQSQDNTGSVIKLNLTKWLSLQSDFVNGGKVNLSFAQSDFYTQIESITLNDVKMDTTNNGQNWSAPINGSTVRSGLIGSVTNHDIVITLKNSQTLSSLGYSNNKPVYLTHTWTTNDGAIAEESIQVASITPTLDSKAPNTIQKSDFTAGRMTNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSGQLSNARTSLDRNVFFGTLGQSRSYTISYKLKDGYTLESVASKVSARETFDSWMEVDYLDSYDSGAPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATN

SEQ ID NO: 42782 - protein, 254 aa, Staphylococcus epidermidis VCU109; identical to SEQ ID NO: 42680

SEQ ID NO: 42783 - protein, 440 aa, Staphylococcus epidermidis VCU109
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKP

SEQ ID NO: 42784 - protein, 219 aa, Staphylococcus epidermidis VCU109; identical to SEQ ID NO: 39379

SEQ ID NO: 42785 - protein, 931 aa, Staphylococcus epidermidis VCU109
MIKKNNLLTKKKPIANKSNKYAIRKFTVGTASIVIGATLLFGLGHNEAKAEENTVQDVKDSNMDDELSDSNDQSSNEEKNDVINNSQSINTDDDNQIKKEETNSNDAIENRSKDITQSTTNVDENEATFLQKTPQDNTQLKEEVVKEPSSVESSNSSMDTAQQPSHTTINSEASIQTSDNEENSRVSDFANSKIIESNTESNKEENTIEQPNKVREDSITSQPSSYKNIDEKISNQDELLNLPINEYENKVRPLSTTSAQPSSKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 42786 - protein, 728 aa, Staphylococcus epidermidis VCU109; identical to SEQ ID NO: 39721

SEQ ID NO: 42787 - protein, 480 aa, Staphylococcus epidermidis VCU109
NPIKIETTDNSGQTVTNKVEGLPDGVTFDEATNTISGTPSEVGSYTVTVTTTDENGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPTINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42788 - protein, 434 aa, Staphylococcus epidermidis VCU109; identical to SEQ ID NO: 39380

SEQ ID NO: 42789 - protein, 3692 aa, Staphylococcus epidermidis VCU109
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEESESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDHVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKIDNATTNNQIDGIVSDGRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42790 - protein, 235 aa, Staphylococcus epidermidis VCU109
MKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGNTAGSVGSYTAAQMAARTGVSASTWEHIIARESNGQLHARNASGAAGLFQTMPGWGSTGSVNDQINAAYKAYKAQGLSAWGM

SEQ ID NO: 42791 - protein, 688 aa, Staphylococcus epidermidis VCU109; identical to SEQ ID NO: 41949

SEQ ID NO: 42792 - protein, 202 aa, Staphylococcus epidermidis VCU117
DGNKVEGKVDSDGNYHIQIPSDERFKVGQQLIVKVVDEEGNVSEPSITMVQKEDMNSEKPSTVTDTITKNNSKSLNHKASEQQSYHNKSEKIKNVNKPTKIVEKDMSTYDYSRYSKDISNKNNKSATFEQQNVSDINNNQYSQNKVNQPVKKSRKNEINKDLPQTGEENFNKSTLFGTLVASLGALLLFFKRRKKDENDEKE

SEQ ID NO: 42793 - protein, 728 aa, Staphylococcus epidermidis VCU117; identical to SEQ ID NO: 39721

SEQ ID NO: 42794 - protein, 434 aa, Staphylococcus epidermidis VCU117; identical to SEQ ID NO: 39380

SEQ ID NO: 42795 - protein, 291 aa, Staphylococcus epidermidis VCU117; identical to SEQ ID NO: 41987

SEQ ID NO: 42796 - protein, 931 aa, Staphylococcus epidermidis VCU117; identical to SEQ ID NO: 42785

SEQ ID NO: 42797 - protein, 1069 aa, Staphylococcus epidermidis VCU117
MKNKQGFLPNLLNKYGIRKLSAGTASLLIGATLVFGINGQVKAAETDNTVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHAESTSDESTYQSDDSKTTQHDNSNTNQDTQSTLNPTSKEYSNKDEVTSSTPKESNNIEKTSLSNDTNHQTTDEVNHSDSDNMTNSTPNDIENELDTTQLTSHDESPSPQSDNFTGFTNLMATPLNLRNDNPRINLLAATEDTKPKTYTKPNNSEYSYLLNDLGYDATTVKENSNLRHAGISQLQDNTGSVIKLNLTKWLSLQSDFVNGGKVNLSFAQSDFYTQIESITLNDVKMDTTNNGQNWSAPINGSTVKSGLIGSVTNQDIVITLKNSQTLSSLGYSNNKPVYLTHTWTTNDGSIAEESIQVASITPTLDSKAPNTIQKSDFTAGRMTNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSGQLNNARTSLDRNVFFGPLGQSRSYTISYKLKDGYTLESIASKVSARETFDSWMEVDYLDSYDSGTPNKRLFGSYASSYIDMIDRIPPVAPKANNITTEDTSIKGTAEADTNINLAFNDGRTLNGKVDSNGNFSIAIPSDYVLTGKETIKITSIDKGDNVSPAITISVIDKTPPAVKAISNKTQEVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNATETTFTIDVEDTTKPTVESIANQTQEVNTEIEPIKIEATDNSGQAVTNKVEGLPAGVTFDEATNTISGTPSEVGSYDITVTATDESGNSETTTFTIDVQDTTKPTVESVADQTQEVNTEITPITIESEDNSGQTVTNKVDGLPDGVTFDEATNTISG

SEQ ID NO: 42798 - protein, 205 aa, Staphylococcus epidermidis VCU117; identical to SEQ ID NO: 39382

SEQ ID NO: 42799 - protein, 681 aa, Staphylococcus epidermidis VCU117; identical to SEQ ID NO: 41996

SEQ ID NO: 42800 - protein, 327 aa, Staphylococcus epidermidis VCU117; identical to SEQ ID NO: 42020

SEQ ID NO: 42801 - protein, 3692 aa, Staphylococcus epidermidis VCU117
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKPQARQALIAKTNEKQSAINSDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQSIQNNDDATTEEKEVANNLVNASQQNVISKIDNATTNNQIDGIVSDGRQSINAITPDTSIKRNAKNYIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDVLQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIAENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNVKNQLNQFIDNQKKIIENTPDATLEEKAEANRLLQNVLTSTSDEIANVDHNNEVDQALDKARPKIEEIVPQVSKKRDVLNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEQKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAEAIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42802 - protein, 688 aa, Staphylococcus epidermidis VCU117; identical to SEQ ID NO: 39381

SEQ ID NO: 42803 - protein, 824 aa, Staphylococcus epidermidis VCU117; identical to SEQ ID NO: 41988

SEQ ID NO: 42804 - protein, 172 aa, Staphylococcus epidermidis VCU117; identical to SEQ ID NO: 30248

SEQ ID NO: 42805 - protein, 219 aa, Staphylococcus epidermidis VCU117; identical to SEQ ID NO: 39379

SEQ ID NO: 42806 - protein, 235 aa, Staphylococcus epidermidis VCU117; identical to SEQ ID NO: 41955

SEQ ID NO: 42807 - protein, 343 aa, Staphylococcus epidermidis VCU117; identical to SEQ ID NO: 39377

SEQ ID NO: 42808 - protein, 386 aa, Staphylococcus epidermidis VCU118
MKKSNKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTHPADQENNAPQAGVGTPGAENTPQAGGENHNQDNAVTAAGTSGEQNGGKPATSTTGQEAAQPNGPQGTSVAQPGNDASSQGHDTPQADAGTHSTEGQPAVTTGEQASGKPAATKPEGAGTETAPAPNTADESHAQPSPQSGGITATQAGQVKPSGDSTPTGKPNTADDQGTQIKPTSNQGTTVTTGETGNQKPSGQTGNTENTPNDGTQVKPNNDPAATGTPNANEEQTGQPNATVTPGQGNDEINGATKPGEVSPKPEENNPAVTEPGTTAPGNTNQGT

SEQ ID NO: 42809 - protein, 3692 aa, Staphylococcus epidermidis VCU118
MNLFRKQKFSIRKFNIGIFSALIATVAFLAHPGQATASELEPSQNNDTTAQSDGGLENTSQSNPISEETTNTLSEQTVPSSTENKQTQNDPHHNAQPIAINVEEAESAQTAPYTNIYENNDTSDNGLHVNQPVKHHIEAQSEDVTNHTDSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTTDNTVTGQQTPFSINVIMNKDDLSEQVNKDIIPSNYTLASYNKYNKLKERAQTVLDEETNNTPFNQRYSQTQIDDLLHELQTTLISRVSASREINDKAQEMTDGVYDSTELTTEEKDTLVDQIENHKNEISNNIDDELTDDGVERVKEAGLHTLESDTPHPVTKPNARQVVNNKAEQQKTLIRNNHEATTEEQNEAISQVEAHSSDAIAKIGEAETDTTVNEARDNGTRLIATDIPNPTKKAEAREAVTNSANSKIKDINNNTQATLDERNDAITLVNRSKDEAIQNINTAQGNDDVTEAQNNGTNTIQQVPLTPVKRQNAIATINAKADEQKRLIQANNNATTEEKADAERKVNEALLTATQNISNAPTNRDVDQAQTMGSGIISTISPATKIKEDARAAVEAKAIAQNQQINSNNMATTEEKQDALNQVEAHKQATIANINQAQSTQQVSEAKNNGINTINQDQPNAVKKNNTKTLLEQKGNEKKSAIAQTPDATTEEKQEAVSVVSQAVTNGNNHINQANSNDDVDQALSNAEQIITHTDVNVQKKPQARQALIAKVNEKQSAINTDNEGTIEEKQKAIQSLNDAKNSADEQITQAASNQNVDNALNIGISNISKIQTNFTKKQQARDQVNQKFQEKEAELNSTPHATQDEKQDALTRLTQVKESTLNDINQAQTNQNVDTALTNGIQNIQNIQVDVRKKQEARTTINDIVQQHKQTIQNNDDATTEEKEVANNLVNVSQQNVISKIDNATTNNQIDGIVSDGRQTINAITPDTSIKRNAKNDIDGKAADRKIKIQRINDATAEEIQEANRKIEEAKIEAKDNIQQSSTRDQVNEAKTNGINKIENITPATTVKSEARQAVQNKANEQINHIQNTPDATNDEKQEAINRVSAELARVQAQINAEHTTQGVKNIKDDAITSLSRINAQVVEKESARNAIEQKSTQQTQFINDNDNATDEEKEVANNLVIARKQNALDNINSLSSNSDIENAKVTGINEIAKVLPATSVKSKAKKDIDQKLAQQINQIQTHQTATIEEKEAAIQLANQKANEARTAIQNEHSNNGVAQAKSNGIHEIELVTPDAHKKSDAKQSIDDKYNEQSNTINTTPDATDEEKQKALDKLKIAKDAGYNKVDQAQTNQQVSDAKTEAIDTITNIQANVAKKPSARMELDSKFEDLKRQINATPNATEEEKQDAIQRLNVKREEVKNLINQDRRDNDVEQHKNTGLQELETIHANPTRKSDALQELQTKFISQTELINNNKDATNEEKAEAKRLLEISKNKTITNINQAQTNNQVDNAKDNGMNEIATIIPATTIKTDAKTAIDKKAEQQVTIINGNNDATDEEKAEARKLVEKAKTEVKSNITNSDTEREVNSAKTNGLEKINNIQPSTQTKTNAKQEINDKAQEQLIQINNTPDATEEEKQEATNRVNAGLAQAIQNINNAHSTQEVNESKTHSIATIKSILPNVIKKPTAINDLTQEANNQKTLIGNDGNATDDEKEAAKQLVTQKLNEEIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQDTNGVNDRIQAALANQNVTDEKNNILETIRNVEPIVVVKPKANEIIRKKAAEQTTLINQNQDATLEEKQIALGKLEEVKNEALNQVSQAHSNNDVKIAENNGIAKISEVHPETSIKRNAKQEIEQVAQSQIDTINANNKSTNEEKSAAIDRVNVAKIDAINNIANATTTQLVNDAKNNGNTSITQILPSTAVKTNALAALATDAKNKNAIIDQTPNATAEEKEEANNKVDRLQEEADANILKAHTTEEVNNIKNQAVQNINAVQVEVIKKQNVKNQLNQFVDNQKKIIENTPDATLEEKAEANRLLQNVLTSASDEIANVVHNNEVDQALDKARPKIEAIVPQVSKKRDVLNAIQEAFNSQTQEIQENQEATNEEKTEALNKINQLLNQAKVNIDQAQSNKDVDNAKTRSIQDIEQIQAHPQTKETGRHRLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATDDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINRANTDNEVDNAKTSGLNNINEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTPDVTHEERNDAINHVKEQLSLVFNAIEKDQKDIQVAQDELFGLNELNSIFINITQKPTARKAISDKASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNQSFITINNVNKNQEVYDTKNKTIEAIHRIKPITIIKPQALNEITNQLDAQRDLIKNNNESTLEEKASAIDKLIKTAARIAEAIDKAQTNEDVKNIKKQSIDEVSKILPVIEIKLAARNEIHQKAEVIRGLINNNEEATKEEKDVALNQLDTTLTQANLSIDQALTNEAVNRAKEIATSEINKISVITIKKPEAIADIQELADKKLNKFKQNQEATIEEKQSAINELDQALKSAINHIHQSQNNESVSAALKESISLIDSIEIQAHKKLEAKAYIDGYSDDKINDISSRATNEEKQIFVSKLKALINRAHKQIDEAETFVSVDTIVRNFKVEVDKLNSIVRKKAKALKEIELEADHVKQMINANLSASTRVKQNARTLINEIVSNALSQLNKVTTNKEVDELVNETIEKLKSIQLREDKILSSQRSTTSMTEKSNQCYSSENNTIKSLPETGNVDKSVPLAGVTLISGLAIMSSRKKKKDKKVND

SEQ ID NO: 42810 - protein, 434 aa, Staphylococcus epidermidis VCU118; identical to SEQ ID NO: 39380

SEQ ID NO: 42811 - protein, 926 aa, Staphylococcus epidermidis VCU118
MKNKQGFLPNLLNKYGIRKLSAGTASLLIGATLVFGINGQVKAAETDNTFSQNEDNKTNDSKSSDEELVKSEDDQTSNTSTDTTLESEFEQNNNPSSIEESTNRNDEDTLNQRTASETEEDTQVKSADTQTTNETTNKNDDNATTNHTESTSDESTYQSDDSNTTQHDNSNTNQDTQSTLNPTSKESSNKDETTSPTPKESTSIEKTSLLNDTNHQTTDEVNHSDSDNMTNSTPNDTENKLDTTQLTSHDESPSPQSDNFTGFTNLMATPLNLRNDNPRINLLAATEDTKPKTYTKPNNSEYSYLLNDLGYDATTVKENSNLRHAGISQLQDNTGSVIKLNLTKWLSLQSDFVNGGKVNLSFAQSDFYTQIESITLNDVKMDTTNNGQNWSAPINGSTVNSGLIGSVTNHDILITLKNSQTLSSLGYSNNKPVYLTHTWTTNDGAIAEESIQVASITPTLDSKAPNTIQKSGFTAGRVINKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSDQLSNARTSLDKNVFFGTLGQSRSYTISYKLKDGYTLESVASKVSARETFDSWMEVDYLDSYDSGAPNKRLFGSYASSYIDVIDRIPPVAPKANNITTEDTSIKGTAEADTNINLAFNDGRTLNGKVDSNGNFSITIPSDYVLTGKETIKITSIDKGANVSPAITISVIDKTPPAVKAISNKTQEVNTAFNPFIIEATDNSGDKVIHDVRGLPAGVTFNNSSNMISGTPTNVGAYTVTVISRDVKGNETETSFKINVVDTTKPTVEDIANQTQEVNTEIEPIKIEATDNSGQAVTNKVDGLPVGVTFDEATNTISGTPSEVGSYDITVTTTDESGNATESTFTIDVEDTTK

SEQ ID NO: 42812 - protein, 103 aa, Staphylococcus epidermidis VCU118
MIKKNNLLTKKKPIANKSNKYAIRKFTVGTASIVIGATLLFGLGHNEAKAEENTVQDVKDSNTDDELSDSNDQSSNEEKNDVINNSQSINTDDDNQIKKRRNE

SEQ ID NO: 42813 - protein, 235 aa, Staphylococcus epidermidis VCU118; identical to SEQ ID NO: 42334

SEQ ID NO: 42814 - protein, 219 aa, Staphylococcus epidermidis VCU118; identical to SEQ ID NO: 42003

SEQ ID NO: 42815 - protein, 377 aa, Staphylococcus epidermidis VCU118
DSDSDSDSDSDSDADSDSDSDSDSDSDSDSDSDSDADSDSDADSDSDSDSDSDSDSDSDSDSDSDSDSDSDSDSDSDSDSDSDSDSDSDSDSDSDSDSDSDSDSDSDADSDSDADSDSDSDSDSDSDSDSDSDSDSDSDSDSDSDSDSDSDSDSDSDSDSDSDSDSDSDSDSDSDSDSDSDSDSDADSDSDSDSDSDSDSDSDADSDSDSDSDSDADSDSDADSDSDSDSDSDSDSDSDSDSDSDADSDSDSDSDSDSDSDSDADSDSDSDSDSDADSDSDSDSDSDSDSDSDSDSDSDSDSDSDSDSDSDSDSDSDSDSDSDSDSDADSDKNAKDKLPDTGANEDHDSKGTLLGTLFAGLGALLLGRRRKKDNKEK

SEQ ID NO: 42816 - protein, 327 aa, Staphylococcus epidermidis VCU118
MNWQRKCILTTLLVLSSLFLVFSTITYASERDYKDSLKITTHNVYFLPTAIYPNWGQSQRADLISKADYIQNQDVVILNELFDKKASKRLLARLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKNIRQSQMSEIKQFIKDKNIPKNEPVYIGGDLNVIKDSDEYQQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42817 - protein, 681 aa, Staphylococcus epidermidis VCU118
MKNNNRIKRFSIRKYAVGVVSIITGVTIFIGGQQAQAAEISVQHADAHPEDSQTTQQLKNDKVEETLKASKQGTADSQQVQRIDQSKTNQNNQHSVAESAQLKSYETANQPKVEEESSVKQDVQPSKNVNQQDVATQSNERENNDIKGESQTSKASNQHTQSSNSHNQSIGTKDSDSEELDQPLVKLQKPSNDSTYQTQSKAKQDSFKQLPHEKTTKHQIQTTENKQTTNVDSKKANDTQDARQHTQEPKNDTSTSQKNHHQVATKEQSNRSTTRETQKQSANSNQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42818 - protein, 170 aa, Staphylococcus epidermidis VCU118
MKTKQLLSTTAIAGTLLLSGLHAPQAKAESTINGSNAVDIIQQVDKQHGNQPDLIRYGQPKDHGDYYEVTTNNKSGVGGAGITRLYKDGTVKHSTDSSGQDFKTFGHYEDTSSQSSSHNQNTTQAATQHDTTDQTLPETGQSHTDITTMIGIIALIAGIGFIARRASHQA

SEQ ID NO: 42819 - protein, 291 aa, Staphylococcus epidermidis VCU118
MKKIDSWLTKHGLKNRLTLAVIVIFIIFLILLFMFVNLSDEDTGQITITENAELRTGPNAAYPVIYKIEKGESFKKIDRKGKWIEVQNHAGTEKGWVAGWHTNLNIPADQSLSSNPLKGKTIVLDPGHGGSDQGASSSTPSKSLEKNYTLKTAKELKKLLNKEGAHVKMTRSNDKYVSLDDRNIKGDAFISIHNDALDSSNANGVTVYWFKDKQESLAQTLNSVIQKKALLTNRGSRQQNYQVLRQTDIPAVLLELGYISNPTDESMINDQLHRQVVEQAIVDGLKQYFSS

SEQ ID NO: 42820 - protein, 688 aa, Staphylococcus epidermidis VCU118
MKTRQNKYSIRKFSVGASSILIAALLFMGGGSAQAAEQQQDKGTVENSTTQSIGDKNEKLSEQQSTQNKNVNEKSNVNSITENENLHNETPKNEDLIQQQKDSQNDNKSESVVEQNKKNEAFVQNHSEEKPQQEQVELEKHASENNQTLHSNAAQSNEDVKTKPSQLDNTTAQQEDSQKENLSKQDTQSSKNTDLLRTTGQNQSKDSQSTEEVNKEVNNDTQQVTAKKDDDKVETFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLVYDVGKMYGNKDSRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42821 - protein, 728 aa, Staphylococcus epidermidis VCU118
MKNKKNSYSIRKLSVGASSIIVASMLFIGGGSVHAAESNQLENQEQSEVSASHSIELQHKDQEIQQPENKDNKNYHSETIDKNPTIHNNDYSYHETPSTDVKSNEDKQIDSQSNQPQTSMTKNDQQNPKKVAEHTTKGINAKKEETRKNENAKSLVKLQQDDKTTSEQTKMKESREQEITNEQKQLQSKDVKNAQQENQNIEQEKSQEKINLQQSSIEKVQKSSRIDGKLDHQYNKDATQSNEGIASENVSEQHITAKDAGVTRNNRGDEHLNQEKPTISSDKELKVDDIDKDLSTKESPENEKDDSRKGIKALTKNSQATTRNTATTEASKELKDQTNKVASQKEYKNHDPIILVHGFNGYASGTGPITGKGNYWGGDRLKIIQDYRAKGYNVMEASVSAFGSNYDRAVELYYYIKGGRVDYGAAHAAKYGHERYGKTYAGAYKEWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42822 - protein, 414 aa, Staphylococcus epidermidis VCU118
NVEDTTKPTVEDIADQTQEVNTEIEPIKIEATDNSGQAVTNKVDGLPAGVTFDEATNTISGTPTEVGKYLITITTIDKDGNTATTTLTINVIDTAAPEQPTINKVTENSTEVSGRGEPGTVVEVTFPDGNKVEGKVDSDGNYHIQVPSETTLKGGQPLQVIAIDKAGNKSESTTTTVIDTTAPEQPTINKVTENSTEVSGRGEPGTVVEVTFPDGNKVEGKVDSDGNYHIQIPSDEKFKVGQQLIVRVVDEEGNVSEPSIATVHEEDKNSEKPGTVTDTVTKNNSKSLKHKASEQQSYHNKSEKIMSVNKPTKIVEKDMSTYDYSRYSKDISNKNNKSATFEQQNVSDINNNQYSRNKVNQPVKKSRTNEINKDLPQTGEENFNKSTLFGTLVASLGALLLFFKRRKKDEDGKE

SEQ ID NO: 42823 - protein, 98 aa, Staphylococcus epidermidis VCU120; identical to SEQ ID NO: 42715

SEQ ID NO: 42824 - protein, 688 aa, Staphylococcus epidermidis VCU120; identical to SEQ ID NO: 39381

SEQ ID NO: 42825 - protein, 235 aa, Staphylococcus epidermidis VCU120; identical to SEQ ID NO: 41955

SEQ ID NO: 42826 - protein, 291 aa, Staphylococcus epidermidis VCU120; identical to SEQ ID NO: 39372

SEQ ID NO: 42827 - protein, 814 aa, Staphylococcus epidermidis VCU120; identical to SEQ ID NO: 42202

SEQ ID NO: 42828 - protein, 172 aa, Staphylococcus epidermidis VCU120; identical to SEQ ID NO: 30248

SEQ ID NO: 42829 - protein, 376 aa, Staphylococcus epidermidis VCU120
TEKITKQPVDEIVHYGGEEIKPGHKDEFDPNAPKGSQTTQPGKPGVKNPDTGEVVTPPVDDVTKYGPVDGDPITSTEEIPFDKKREFDPNLAPGTEKVVQKGEPGTKTITTPTTKNPLTGEKVGEGEPTEKITKQPVDEIVHYGGEQIPQGHKDEFDPNAPVDSKTEVPGKPGVKNPDTGEVVTPPVDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGTPAEPGKPAEPGTPAEPGKPVEPGTPAQSGAPEQPNRSMHSTDNKNQLPDTGENRQANEGTLVGSLLAIVGSLFIFGRRKKGNEK

SEQ ID NO: 42830 - protein, 728 aa, Staphylococcus epidermidis VCU120; identical to SEQ ID NO: 39721

SEQ ID NO: 42831 - protein, 327 aa, Staphylococcus epidermidis VCU120; identical to SEQ ID NO: 42156

SEQ ID NO: 42832 - protein, 681 aa, Staphylococcus epidermidis VCU120; identical to SEQ ID NO: 42118

SEQ ID NO: 42833 - protein, 343 aa, Staphylococcus epidermidis VCU120; identical to SEQ ID NO: 39377

SEQ ID NO: 42834 - protein, 1116 aa, Staphylococcus epidermidis VCU120
MINKKNNLLTKKKPITNKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDNDSDSDNDSDLGNSSDKSTKDKLPDTGANEDYGSKGTLLGTLFAGLGALLLGKRRKNRKNKN

SEQ ID NO: 42835 - protein, 219 aa, Staphylococcus epidermidis VCU120; identical to SEQ ID NO: 39379

SEQ ID NO: 42836 - protein, 434 aa, Staphylococcus epidermidis VCU120; identical to SEQ ID NO: 39380

SEQ ID NO: 42837 - protein, 1094 aa, Staphylococcus epidermidis VCU120
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKNLKPDKH

SEQ ID NO: 42838 - protein, 205 aa, Staphylococcus epidermidis VCU120; identical to SEQ ID NO: 42164

SEQ ID NO: 42839 - protein, 728 aa, Staphylococcus epidermidis VCU123; identical to SEQ ID NO: 42772

SEQ ID NO: 42840 - protein, 222 aa, Staphylococcus epidermidis VCU123
TGEVVTPPMDDVTKYGPKVGNPITSTEEIPFDKKRVFNPDLKPGEERVKQKGEPGTKTITTPILVNPITGEKVGEGKSTEKVTKQPVDEIVEYGPTKAEPGKPAEPGKPAEPGKPAEPGTPAEPGKPAEPGKPAEPGTPAEPGKPAEPGKPVEPGKPVEPGTPAQSGAPEQPNRSMHSTDNKNQLPDTGENRQANEGTLVGSLLAIVGSLFIFGRRKKGNEK

SEQ ID NO: 42841 - protein, 132 aa, Staphylococcus epidermidis VCU123
MGKRRQGPINKKVDFLPNKLNKYSIRKFTVGTASILLGSTLIFGSSSHEAKAAEEKQVDPITQANQNDSSERSLENTNQPTVNNEALQSEPTKAEEGGNAEAPQSEPTKAEEGGNAEAPQSEPTKTEEGSNV

SEQ ID NO: 42842 - protein, 291 aa, Staphylococcus epidermidis VCU123; identical to SEQ ID NO: 41987

SEQ ID NO: 42843 - protein, 235 aa, Staphylococcus epidermidis VCU123; identical to SEQ ID NO: 41955

SEQ ID NO: 42844 - protein, 4321 aa, Staphylococcus epidermidis VCU123
MNNRDKLQKFSIRKYAIGTFSTVIATLVFMGINTNHASADELNQNQKLIKQLNQTDDDDSNTHSQEIENNKQNSSGKTESLRSSTSQNQANARLSDQFKDTNETSQQLPTNVSDDSINQSHSEANMNNEPLNVDNSTMQAHSKIVSDSDGNASENKHHKLTENVLAESRASKNDKEKENLQEKDKSQQVHPPLDKNALQAFFDASYHNYRMIDRDRADATEYQKVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYGDENFALLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSIDSVYDPLSYVKNVTGTVLGIYPSYLPYNQERWQGANAMNAYQIEELFSQENLQNAARSGRPIQFLVGFDVEDSHHNPETLLPVNLYVKPELKHTIELYHDNEKQDRKEFSVSKRAGHGVFQVMSGTLHNTVGSGILPYQQEIRIKLTSNEPIKDSEWSITGYPNTLTLQNAVGRTNNATEKNLALVGHIDPGNYFITVKFGDKVEQFEIRSKPTPPRIITTANELRGNPNHKPEIRVTDIPNDTTAKIKLVMGGTDGDHDPEINPYTVPENYTVVAEAYHDNDPSKNGVLTFRSSDYLKDLPLSGELKAIVYYNQYVQSNFSNSVPFSSDTTPPTINEPAGLVHKYYRGDHVEITLPVTDNTGGSGLRDVNVNLPQGWTKTFTINPNNNTEGTLKLIGNIPSNEAYNTTYHFNITATDNSGNTTNPAKTFILNVGKLADDLNPVGLSRDQLQLVTDPSSLSNSEREEVKRKISEANANIRSYLLQNNPILAGVNGDVTFYYRDGSVDVIDAENVITYEPERKSIFSENGNTNKKEAVITIARGQNYTIGPNLRKYFSLSNGSDLPNRDFTSISAIGSLPSSSEISRLNVGNYNYRVNAKNAYHKTQQELNLKLKIVEVNAPTGNNRVYRVSTYNLTNDEINKIKQAFKAANSGLNLNDNDITVSNNFDHRNVSSVTVTIRKGDLIKEFSSNLNNMNFLRWVNIRDDYTISWTSSKIQGRNTDGGLEWSPDHKSLIYKYDATLGRQINTNDVLTLLQATAKNSNLRSNINSNEKQLAERGSNGYSKSIIRDDGEKSYLLNSNPIQVLDLVEPDNGYGGRQVSHSNVIYNEKNSSIVNGQVPEANGASAFNIDKVVKANAANNGIMGVIYKAQLYLAPYSPKGYIEKLGQNLSNTNNVINVYFVPSDKVNPSITVGNYDHHTVYSGETFKNTINVNDNYGLNTVASTSDSAITMTRNNNELVGQAPNVTNSTNKIVKVKATDKSGNESIVSFTVNIKPLNEKYRITTSSSNQTPVRISNIQNNANLSIEDQNRVKSSLSMTKILGTRNYVNESNNDVRSQVVSKVNRSRNNATVNVTTTFSDGTTNTITVPVKHVLLEVVPTTRTTVRGQQFPTGKGTSPNDFFSLRTGGPVDARIVWVNNQGPDINSNQIGRDLTLHAEIFFDGETTPIRKDTTYKLSQSIPKQIYETTINGRFNSSGDAYPGNFVQAVNQYWPEHMDFRWAQGSGTPSSRNAGSFTKTVTVVYQNGQTENVNVLFKVKPNKPVIDSNSVISKGQLNGQQILVRNVPQNAQVTLYQSNGTVIPNTNTTIDSNGIATVTIQGTLPTGNITAKTSMTNNVTYTKQNSSGIASNTTEDISVFSENSDQVNVTAGMQAKNDGIKIIKGTNYNFNDFNSFISNIPAHSTLTWNEEPNSWKNNIGTTTKTVTVTLPNHQGTRTVDIPITIYPTVTAKNPVRDQKGRNLTNGTDVYNYIIFENNNRLGGTASWKDNRQPDKNIAGVQNLIALVNYPGISTPLEVPVKVWVYNFDFTQPIYKIQVGDTFPKGTWAGYYKHLENGEGLPIDGWKFYWNQQSTGTTSDQWQSLAYTRTPFVKTGTYDVVNPSNWGVWQTSQSAKFIVTNAKPNQPTITQSKTGDVTVTPGAVRNILISGTNDYIQASADKIVINKNGNKLTTFVKNNDGRWTVETGSPDINGIGPTNNGTAISLSRLAVRPGDSIEAIATEGSGETISTSATSEIYIVKAPQPEQVATHTYDNGTFDILPDNSRNSLNPTERVEINYTEKLNGNETQKSFTITKNNNGKWTINNKPNYVEFNQDNGKVVFSANTIKPNSQITITPKAGQGNTENTNPTVIQAPAQHTLTINEIVKEQGQNVTNDDINNAVQVPNKNRVAIKQGNALPTNLAGGSTSHIPVVIYYSDGSSEEATETVRTKVNKTELINARRRLDEEISKENKTPSSIRNFDQAMNRAQSQINTAKSDADQVIGTEFATPQQVNSALSKVQAAQNKINEAKALLQNKADNSQLVRAKEQLQQSIQPAASTDGMTQDSTRNYNNKRQAAEQAIQHANSVINNGDATSQQINDAKNTVEQAQRDYVEAKSNLRADKSQLQSAYDTLNRDVLTNDKKPASVRRYNEAISNIRKELDTAKADASSTLRNTNPSVEQVRDALNKINTVQPKVNQAIALLQPKENNSELVQAKKRLQDAVNDIPQTQGMTQQTINNYNDKQREAERALTSAQRVIDNGDATTQEITSEKSKVEQAMQALTNAKSNLRADKNELQTAYNKLIENVSTNGKKPASIRQYETAKARIQNQINDAKNEAERILGNDNPQVSQVTQALNKIKAIQPKLTEAINMLQNKENNTELVNAKNRLENAVNDTDPTHGMTQETINNYNAKKREAQNEIQKANMIINNGDATAQDISSEKSKVEQVLQALQNAKNDLRADKRELQTAYNKLIQNVNTNGKKPSSIQNYKSARRNIENQYNTAKNEAHNVLENTNPTVNAVEDALRKINAIQPEVTKAINILQDKEDNSELVRAKEKLDQAINSQPSLNGMTQESINNYTTKRREAQNIASSADTIINNGDASIEQITENKIRVEEATNALNEAKQHLTADTTSLKTEVRKLSRRGDTNNKKPSSVSAYNNTIHSLQSEITQTENRANTIINKPIRSVEEVNNALHEVNQLNQRLTDTINLLQPLANKESLKEARNRLESKINETVQTDGMTQQSVENYKQAKIKAQNESSIAQTLINNGDASDQEVSTEIEKLNQKLSELTNSINHLTVNKEPLETAKNQLQANIDQKPSTDGMTQQSVQSYERKLQEAKDKINSINNVLANNPDVNAIRTNKVETEQINNELTQAKQGLTVDKQPLINAKTALQQSLDNQPSTTGMTEATIQNYNAKRQKAEQVIQNANKIIENAQPSVQQVSDEKSKVEQALSELNNAKSALRADKQELQQAYNQLIQPTDLNNKKPASITAYNQRYQQFSNELNSTKTNTDRILKEQNPSVADVNNALNKVREVQQKLNEARALLQNKEDNSALVRAKEQLQQAVDQVPSTEGMTQQTKDDYNSKQQAAQQEISKAQQVIDNGDATTQQISNAKTNVERALEALNNAKTGLRADKEELQNAYNQLTQNIDTSGKTPASIRKYNEAKSRIQTQIDSAKNEANSILTNDNPQVSQVTAALNKIKAVQPELDKAIAMLKNKENNNALVQAKQQLQQIVNEVDPTQGMTTDTANNYKSKKREAEDEIQKAQQIINNGDATEQQITNETNRVNQAINAINKAKNDLRADKSQLENAYNQLIQNVDTNGKKPASIQQYQAARQAIETQYNNAKSEAHQILENSNPSVNEVAQALQKVEAVQLKVNDAIHILQNKENNSALVTAKNQLQQSVNDQPLTTGMTQDSINNYEAKRNEAQSAIRNAEAGINNGDATAKQISDEKSKVEQALAHLNDAKQQLTADTTELQTAVQQLNRKGDTNNKKPRSINAYNKAIQSLETQITSAKDNANAVIQKPIRTVQEVNNALQQVNQLNQQLTEAINQLQPLSNNDALKAARLNLENKINQTVQTDGMTQQSIEAYQNAKRVAQNESNTALALINNGDADEQQITTETDRVNQQTTNLTQAINGLTVNKEPLETAKTALQNNIDQVPSTDGMTQQSVANYNQKLQIAKNEINTINNVLANNPDVNAIKTNKAEAERISNDLTQAKNNLQVDTQPLEKIKDNFKMKLIKVLTQME

SEQ ID NO: 42845 - protein, 327 aa, Staphylococcus epidermidis VCU123
MNWQRKCILTTLLVLSSLFLVFSTITYASERDFKDSLKITTHNVYFLPTAIYPNWGQSQRADLISKADYIQNQDVVILNELFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDLDHAQPSSWHNDTHRVKSPEWSVKSWGKTYKYNDYSDHYPLSGYASNE

SEQ ID NO: 42846 - protein, 681 aa, Staphylococcus epidermidis VCU123; identical to SEQ ID NO: 41996

SEQ ID NO: 42847 - protein, 814 aa, Staphylococcus epidermidis VCU123
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGENHNQDTAVTSTGTNGEQNGGKPATSTTGQDAAQSNGPQGTSVAQPGNDASSQGHDTPQADAGTHNTEGQPAVTTGEQTGGKPAATKPEGASAETAPAPNNADENHAQPSPQTGGTTATQAGQVKPSGDSTPTGEPNKADDQGTQIKPTSNQGTTATTNEIGNQKPSGQTGNTENTPNDGTQVKPNNDPAVTGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPNPDQNNTPTNGQDGNQTGQGTQVKPNNDQTATGTQGATGNQNAEQGNTEQNNQNAQPSAPGTTNQAGATVKPGTTPNQDAEVKPNTDQTATGTQGATGDQNAEQGNTEQNNQNAEQGNTEQNNQNAEQGNTGQEGSNPNQSGQLGATVKPGSAPNQDTEVKPNPDQNNNPTTGQDANQTGQGTQVKPNNDQTTTGTPAGTDNQNTQQGNTEQNNQNAEQGNTGQEGSNPNQSGQLGATVKPGSAPNQDTEATPNPDQNNTPTNGQDGDQTNQSTQDDNDNQNTQQGNTKQNNQNAEQGNTGGTDKDAKVNTNDDETKTDVKNDTELPETGLSNEYDYTTTVFGSIALISSLLLLRRQRKESK

SEQ ID NO: 42848 - protein, 688 aa, Staphylococcus epidermidis VCU123; identical to SEQ ID NO: 42767

SEQ ID NO: 42849 - protein, 219 aa, Staphylococcus epidermidis VCU123; identical to SEQ ID NO: 39379

SEQ ID NO: 42850 - protein, 434 aa, Staphylococcus epidermidis VCU123; identical to SEQ ID NO: 39380

SEQ ID NO: 42851 - protein, 1097 aa, Staphylococcus epidermidis VCU123
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEKVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTSHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITHTNVNVQKKTSSQTSIDC

SEQ ID NO: 42852 - protein, 688 aa, Staphylococcus epidermidis VCU125
MKTRQNKYSIRKFSVGASSILIAALLFMGGGSAQAAEQQQDKGTVENSTTQSIGDGNEKLSEQQSTQNKNVNEKSNVNSITENESLHNETPKNEDWIQQQKDSQNDNKSESVVEQNKENEAFVQNHSEEKPQQEQVELEKHASENNQTLHSKAAQSNEDVKTKPSQLDNTAAKQEDSQKENLSKQDTQSSKTTDLLRATAQNQSKDSQSTEEINKEVNNDTQQVTAKNDDAKVESFNLNSKEEPLKVDKQANPTTDKDKSSKNDKGSQDGLANLESNAVATTNKQSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKDGHERYGKTYEGVYKDWKPGQKIHLVGHSMGGQTIRQLEELLRHGNPEEVEYQKQHGGEISPLYQGGHDNMVSSITTLGTPHNGTHASDLLGNEAIVRQLAYDVGKMYGNKDSRVDFGLEHWGLKQKPNESYIQYVKRVQNSKLWKSKDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLAEDLVQSEQLTSTNK

SEQ ID NO: 42853 - protein, 728 aa, Staphylococcus epidermidis VCU125; identical to SEQ ID NO: 39721

SEQ ID NO: 42854 - protein, 576 aa, Staphylococcus epidermidis VCU125
QEVNTEINPIKIEATDNSGQAVTNKVEGLPAGITFDEATNTISGTPSEVGSYTVTVTTTDENGNATETTFTIDVEDTTKPTVEDITDQTQEINTEINPIKIETTDNSGQTVTNKVEGLPDGVTFDEATNTISGTPSEVGSYTVTVTTTDENGNATETTFTIDVEDTTKPTVEDITDQTQEINTEMTPIKIEATDNSGQAVTNKVEGLPDGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPTINKVTENSTEVSGRGEPGTVVEVTFPDGNKVEGKVDSDGNYHIQIPSDERFKVGQQLIVKVVDEEGNVSEPSITMVQKEDKNSEKLSTVTGTVTKNNSKSLKHKASEQQSYHNKSEKIKNVNKPTKIVEKDMSTYDYSRYSKDISNKNNKSATFEQQNVSDINNNQYSRNKVNQPVKKSRKNEINKDLPQTGEENFNKSTLFGTLVASLGALLLFFKRRKKDENDEKE

SEQ ID NO: 42855 - protein, 291 aa, Staphylococcus epidermidis VCU125; identical to SEQ ID NO: 39372

SEQ ID NO: 42856 - protein, 434 aa, Staphylococcus epidermidis VCU125; identical to SEQ ID NO: 39380

SEQ ID NO: 42857 - protein, 235 aa, Staphylococcus epidermidis VCU125; identical to SEQ ID NO: 42334

SEQ ID NO: 42858 - protein, 205 aa, Staphylococcus epidermidis VCU125; identical to SEQ ID NO: 39382

SEQ ID NO: 42859 - protein, 1554 aa, Staphylococcus epidermidis VCU125
MFGAADNEAKAAEDNQLESASKEEQKGSRDNESSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSISTDSSVNDKQDYTRSAVASLGVDSNETEAITNAVRDNLDLKAASREQINEAIIAEALKKDFSNPDYGVDTPLALNTSQSKNSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFTPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISNVKVTLKNKNGDTIGTTTTDSNGKYEFTGLENGDYTIEFETPEGYTPTKQNSGSDEGKDSNGTKTTVTVKDADNKTIDSGFYKPIYNLGDYVWEDTNKDGIQDDSEKGISGVKVTLKDKNGNAIGTTTTDASGHYQFKGLENGSYTVEFETPSGYTPTKANSGQDITVDSNGITTTGIINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSNSDSDSDSDSDSDSDSDSDSDSDSDSDSDADSDSDADSDSDADSDSDADSDSDSDSDSDADSDSDSDSDSDADSDSDSDSDSDADSDSDSDSDSDADSDSDSDSDSDADSDSDSDSDSDSDSDSDSDSDSDSDSDSDSDSDSDSDSDSDSDADSDSDSDSDSDADSDSDADSDSDSYSDSDSDSDSDADSDSDSDSDSDSDSDSDADSDSDSDSDSDAESDSDSDSDSDSDSDSDSDSDSDSDSDSDSDSDSDADSDSDSDSDSDSDSDSDSDSDSDSDSDSDADSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 42860 - protein, 681 aa, Staphylococcus epidermidis VCU125; identical to SEQ ID NO: 42027

SEQ ID NO: 42861 - protein, 327 aa, Staphylococcus epidermidis VCU125
MNWQRKCILTTLLVLSSLFLVFSTITYASERDFKDSLKITTHNVYFLPTAIYPNWGQSQRADLISKADYIQNQDVVILNELFDKKASKRLLTRLHSQYPYQTPIVGKGTEGWQNTSGTYRKIKKVSGGVGIVSKWPIVQQEQHIYKKGCGADMAGNKGFAYIKINKNGKYHHIIGTHLQAEDPTCFKGKDKDIRQSQMSEIKQFIKDKNIPKNEPVYIGGDLNVIKDSDEYQQMANNLNVSLPTQFDGNAYSWDTSSNSIAKYNYPKLEPQHLDYILLDHDHAQPSSWHNDTHRVKSPEWSVKSWGKTYKYNDYSDHYPLSGYASNE

SEQ ID NO: 42862 - protein, 219 aa, Staphylococcus epidermidis VCU125; identical to SEQ ID NO: 39379

SEQ ID NO: 42863 - protein, 892 aa, Staphylococcus epidermidis VCU125; identical to SEQ ID NO: 41992

SEQ ID NO: 42864 - protein, 71 aa, Staphylococcus epidermidis VCU125; identical to SEQ ID NO: 42045

SEQ ID NO: 42865 - protein, 1291 aa, Staphylococcus epidermidis VCU125
MKNKQGFLPNLLNKYGIRKLSAGTASLLIGATLVFGINGQVKAAETDNIVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHTESISDESTYQSDDSKTTQHDNSNTNQDTQSTLNPTSKESSNKDEATSPTPKESTSIEKTNLSNDANHQTTDEVNHSDSDNMTNSTPNDTENELDTTQLTSHDESPSPQSDNFTGFTNLMATPLNLRNDNPRINLLAATEDTKPKTYKKPNNSEYSYLLNDLGYDATTVKENSDLRHAGISQSQDNTGSVIKLNLTKWLSLQSDFVNGGKVNLSFAQSDFYTQIESITLNDVKMDTTNNGQNWSAPINGSTVRSGLIGSVTNHDIVITLKNSQTLSSLGYSNNKPVYLTHTWTTNDGAIAEESIQVASITPTLDSKAPNTIQKSDFTAGRMTNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSGQLSNARTSLDRNVFFGTLGQSRSYTISYKLKDGYTLESVASKVSARETFDSWMEVDYLDSYDSGAPNKRLLGSYASSYIDMIDRIPPVAPKANSITTEDTSIKGTAEVDTNINLTFNDGRTLNGKVDSNGNFSIAIPSDYVLTGKETIKITSIDKGDNVSPAITISVIDKTPPAVKAISNKTQKVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNVTETIFTIDVEDTTKPTVESIAGQTQEVNTEIEPIKIEAKDNSGQTVTNKVDGLPDGVTFDEATNTISGTPSEVGSYTVTVTTMDESGNATETTFTIDVEDTTKPTVESVADQTQEVNTEITPITIESEDNSDQAVTNKVDGLPDGVTFDEATNTISGTPSEVGSYTVTVTTTDESGNATETTFTIDVEDTTKPTVKSVSDQTQEVNTEITPIKIEATDNSGQTVTNKVDGLPDGITFDEATNTISGTPSEVGSYDITVTTTDESGNATETTFTINVEDTTKPTVEDIADQTQEVNTEIEPIKIEATDNGGQAVTNKVDGLPDGVTFDEATNTISGTPSEVGSYDIIVTTTDENGNSETTTFTIDVEDTTKPTVESVADQ

SEQ ID NO: 42866 - protein, 815 aa, Staphylococcus epidermidis VCU125; identical to SEQ ID NO: 42535

SEQ ID NO: 42867 - protein, 3692 aa, Staphylococcus epidermidis VCU125
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAQTPDATTEEKQEAVSAVSQAVTNGITHINQANSNDDVDQELSNAEQIITQTNVNVQKKSQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKVDNATTNNQIDGIVSDSRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTAQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTYQTAITEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKRQINATPNATEEEKQDAIQRLNGKRDEVKNLINQDRRDNEVEQHKNIGLQELETIHANPTRKSDALQELQTKFISQTELINNNKDATNEEKDEAKRLLEISKNKTITNINQAQTNNQVDNAKDNGMNEIATIIPATTIKTDAKTAIDKKAEQQVTIINGNNDATDEEKAEARKLVEKAKIEAKSNITNSDTEREVNGAKTNGLEKINNIQPSTQTKTNAKQEINDKAQEQLIQINNTPDATEEEKQEATNRVNAGLAQAIQNINNAHSTQEVNESKTNSIATIKSVQPNVIKKPTAINSLTQEANNQKTLIGNDGNATDDEKEAAKQLVTQKLNEQIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQETNGVNDRIQAALANQNVTDEKNNILETIRNVEPIVIVKPKANEIIRKKAAEQTTLINQNQDATLEEKQIALGKLEEVKNEALNQVSQAHSNNDVKIVENNGIAKISEVHPETIIKRNAKQEIEQDAQSQIDTINANNKSTNEEKSAAIDRVNVAKIDAINNITNATTTQLVNDAKNSGNTSISQILPSTAVKTNALAALASEAKNKNAIIDQTPNATAEEKEEANNKVDRLQEEADANILKAHTTDEVNNIKNQAVQNINAVQVEVIKKQNAKNQLNQFIDNQKKIIENTPDATLEEKAEANRLLQNVLTSTSDEIANVDHNNEVDQALDKARPKIEAIVPQVSKKRDALNAIQEAFNSQTQEIQENQEATNEEKTEALNKINQLLNQAKVNIDQAQSNKDVDSAKTRSIQDIEQIQPHPQTKATGRHRLNEKANQQQSTIATHPNSTIEERQEASAKLQEVLKKAIAKIDKGQTNDDVEKTVVNGIAEIENILPATTVKDKAKADVNAEKEEKNLQINSNDEATTEEKLVASDNLNHVVETTNQAIEDAPDTNQVNVEKNKGIGTIRDIQPLVVKKPTAKSKIESAVEKKKTEINQTQNATHDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINQANTDNEVDNAKTSGLNNITEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTADVTHEERNDAINHVKEQLSLVFNAIEKDRKDIQVAQDELFGLNELNSIFINITQKPTARKAISGMASQLNNSINNTPYATEEERQIALNKVKAIVDDANEKIREANTDSEVLGTKSNAITLLQAISADVQVKPQAFEEINAQAEIQRERINGNSDATREEKEEALKQVDTLVNHSFITINNVNKNQEVYDTKDKTIEAIHKIKPISTIKPQALNEITIQLDTQRDLIKNNKESTVEEKASAIDKLIKTAARIAESIDKAQTNEEVKNIKKQSIDEISKILPVIEIKSAARNEIHQKAEVIRGLINDNEEATKEEKDIALNQLDTTLTQANVSIDQALTNEAVNRAKEIANSEINKISVIAIKKPEAIAEIQELADKKLNKFKQSQEATIEEKQSAINELEQALKSAINHIHQSQNNESVSAALKESISLIDSIEIQAHKKLEAKAYIDGYSDDKINDISSRATNEEKQIFVSKLKALINRTHKQIDEAETFVSVETIVRNFKVEADKLNSIVRKKAKASKEIELEADHVKQMINANLSASTRVKQNARTLINEIVSNALSQLNKVTTNKEVDEIVNETIEKLKSIQIREDKILSSQRSSTSMTEKSNQCYSSENNTIKSLPEAGNADKSLPLAGVTLISGLAIMSSRKKKKDKKVND

SEQ ID NO: 42868 - protein, 343 aa, Staphylococcus epidermidis VCU125; identical to SEQ ID NO: 39377

SEQ ID NO: 42869 - protein, 728 aa, Staphylococcus epidermidis VCU126; identical to SEQ ID NO: 39721

SEQ ID NO: 42870 - protein, 368 aa, Staphylococcus epidermidis VCU126
AGVTFDEATNTISGTPSEVGKYLITITTIDKDGNTATTTLTINVIDTTTPEQPTINKVTENSTEVNGRGEPGTVVEVTFPDGNKVEGKVDSDGNYHIQIPSETTLKGGQPLQVIAIDKAGNKSEATTTNVIDTTAPEQPTINKVTENSTEVNGRGEPGTVVEVTFPDGNKVEGKVDSDGNYHIQIPSDERFKVGQQLIVKVVDEEGNVSEPSITMVQKEDMNSEKPSTVTDTITKNNSKSLNHKASEQQSYHNKSEKIKNVNKPTKIVEKDMSTYDYSRYSKDISNKNNKSATFEQQNVSDINNNQYSQNKVNQPVKKSRKNEINKDLPQTGEENFNKSTLFGTLVASLGALLLFFKRRKKDENDEKE

SEQ ID NO: 42871 - protein, 434 aa, Staphylococcus epidermidis VCU126; identical to SEQ ID NO: 39380

SEQ ID NO: 42872 - protein, 291 aa, Staphylococcus epidermidis VCU126; identical to SEQ ID NO: 41987

SEQ ID NO: 42873 - protein, 235 aa, Staphylococcus epidermidis VCU126; identical to SEQ ID NO: 41955

SEQ ID NO: 42874 - protein, 931 aa, Staphylococcus epidermidis VCU126; identical to SEQ ID NO: 42785

SEQ ID NO: 42875 - protein, 327 aa, Staphylococcus epidermidis VCU126; identical to SEQ ID NO: 42020

SEQ ID NO: 42876 - protein, 681 aa, Staphylococcus epidermidis VCU126; identical to SEQ ID NO: 41996

SEQ ID NO: 42877 - protein, 205 aa, Staphylococcus epidermidis VCU126; identical to SEQ ID NO: 39382

SEQ ID NO: 42878 - protein, 824 aa, Staphylococcus epidermidis VCU126; identical to SEQ ID NO: 41988

SEQ ID NO: 42879 - protein, 688 aa, Staphylococcus epidermidis VCU126; identical to SEQ ID NO: 39381

SEQ ID NO: 42880 - protein, 343 aa, Staphylococcus epidermidis VCU126; identical to SEQ ID NO: 39377

SEQ ID NO: 42881 - protein, 3692 aa, Staphylococcus epidermidis VCU126; identical to SEQ ID NO: 42135

SEQ ID NO: 42882 - protein, 219 aa, Staphylococcus epidermidis VCU126; identical to SEQ ID NO: 39379

SEQ ID NO: 42883 - protein, 172 aa, Staphylococcus epidermidis VCU126; identical to SEQ ID NO: 30248

SEQ ID NO: 42884 - protein, 2043 aa, Staphylococcus epidermidis VCU126
MKNKQGFLPNLLNKYGIRKLSAGTASLLIGATLVFGINGQVKAAETDNTVSQNGDNKTNDSESSDKELVKSEDDKTSSTSTDTNLESEFDQNNNPSSIEESTNRNDEDTLNQRTSTETEKDTHVKSADTQTTNETTNKNDDNATTNHAESTSDESTYQSDDSKTTQHDNSNTNQDTQSTLNPTSKEYSNKDEVTSSTPKESNNIEKTSLSNDTNHQTTDEVNHSDSDNMTNSTPNDIENELDTTQLTSHDESPSPQSDNFTGFTNLMATPLNLRNDNPRINLLAATEDTKPKTYTKPNNSEYSYLLNDLGYDATTVKENSNLRHAGISQLQDNTGSVIKLNLTKWLSLQSDFVNGGKVNLSFAQSDFYTQIESITLNDVKMDTTNNGQNWSAPINGSTVKSGLIGSVTNQDIVITLKNSQTLSSLGYSNNKPVYLTHTWTTNDGSIAEESIQVASITPTLDSKAPNTIQKSDFTAGRMTNKIKYDSSQNSIKSVHTFKPNENFLQTDYRAVLYIKEQVNKELIPYIDPNSVKLYVSDPDGNPISQDRYVNGSIDNDGLFDSSKINEISIKNNNTSGQLNNARTSLDRNVFFGPLGQSRSYTISYKLKDGYTLESIASKVSARETFDSWMEVDYLDSYDSGTPNKRLFGSYASSYIDMIDRIPPVAPKANNITTEDTSIKGTAEADTNINLAFNDGRTLNGKVDSNGNFSIAIPSDYVLTGKETIKITSIDKGDNVSPAITISVIDKTPPAVKAISNKTQEVNTEIEPIKIEATDNSGQAVTNKVEGLPAGMTFDEATNTISGTPSEVGSYDITVTTTDENGNSETTTFTIDVEDTTKPTVESVADQTQEVNTEIEPIKIEATDNSGRAVTNKVDGLPDGVTFDEATNTISGTPSEVGSYDITVTTTDESGNATETTFTIDVEDTTKPTVESIANQTQEVNTEIEPIKIEATDNSGQAVTNKVEGLPAGVTFDEATNTISGTPSEVGSYDITVTATDESGNSETTTFTIDVQDTTKPTVESVADQTQEVNTEITPITIESEDNSGQTVTNKVDGLPDGVTFDEATNTISGTPSKVGSYDITVTTTDESGNSETTTFTINVEDTTKPTVEDITDQTQEVNTEITPIKIEARDNSGQAVTNKVDGLPDGVTFDEATNTISGTPSEVGSYDITVTTTDESGNATETTFTIDVQDTTKPTVESVADQTQEVNTEIEPIKIEARDNSGQAVTNKVDGLPDGVTFDEATNTISGTPSEVGSYDITVTTTDESGNATETTFTIYVEDTTKPTVESVADQTQEVNTEIEPIKIEARDNSGQAVTNKVDGLPDGVTFDKATNTISGTPSEVGSYDITVTTTDESGNSETTTFTIDVEDTTKPTVESVADQTQEINTEMTPIKIEATDNSGQAVTNKVDGLPDGVTFDEATNTISGTPSEVGSYDITVTTTDESGNATETTFTIDVEDTIKPTVESIAGQTQEINTEMTPIKIEATDNSDQTVTNKVEGLPDGVTFDETTNTISGTPSKVGSYDITVTTTDESGNSETTTFTISVEDTTKPTVEDITDQTQEVNTEITPIKIEARDNSGQAVTNKVDGLPDGVTFDEATNTISGTPNEVGSYDIKVTTTDESGNSETTSFTIDVEDTTKPTVEDIADQTQEVNTEITPITIESEDNSGQAVTNKVDGLPDGVTFDEATNTISGTPSEVGSYDITVTTTDENGNSETTTFTIDVEDTTKPTVEDITDQTQEINTEMTLIKIEATDNSGQAVTNKVEGLPDGVTFDEATNTISGTPSEVGSYDITVTTTDENGNSETTTFTIDVEDTTKPTVEDIANQTQEVNTEITPITIESEDNSGQAVTNKVEGLPDGVTFDETTNTISGTPSKVGSYDIKVTTTDESGNSETTTFTIDVEDTTKPTVESVADQTQEVNTEITPITIESEDNSGQTVTNKVDGLPNGVTFDETTNTISGKPSEVGSYDITVTTTDESGNATETIFTIDVEDTTKPTVESIANQTQEVNTEIEPIKIEAIDNSGQAVTNKVDGLPDGVTFDETT

SEQ ID NO: 42885 - protein, 688 aa, Staphylococcus epidermidis VCU127; identical to SEQ ID NO: 39381

SEQ ID NO: 42886 - protein, 603 aa, Staphylococcus epidermidis VCU127
MTLKDKNGNAIGTTTTDASGHYQFKGLENGSYTVEFETPSGYTPTKANSGQDITVDSNGITTTGVINGADNLTIDSGFYKTPKYSVGDYVWKDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDSDSDSDSDSDSDADSDSDSDSDSDSDSDSDADSDSDSDSDSDSDSDSDSDSDSDSDSDSDSDSDSDADSDSDSDSDSDSDSDSDSDSDSDSDSDSDSDSDSDSDSDSDADSDSDSDSDSDADSDSDSDSDSDADSDSDSDSDSDADSDSDSDSDSDSDSDSDSDSDSDSDSDSDSDSDSDSDSDSDSDSDSDSDSDSDSDSDSDSDADSDSDSDSDSDADSDSDSDSDSDSDSDSDSDSDSDSDSDSDSDSDSDADSDSDSDSDSDSDSDSDSDSDSDSDSDSDSDSDSDADSDSDSDSDSDSDSDSDSDSDSDSDSDSDSDSDSDADSDSDSDSDSDADSDSDSDKNAKDKLPDTGANEDHDSKGTLLGTLFAGLGALLLGRRRKKDNKEK

SEQ ID NO: 42887 - protein, 205 aa, Staphylococcus epidermidis VCU127; identical to SEQ ID NO: 39382

SEQ ID NO: 42888 - protein, 291 aa, Staphylococcus epidermidis VCU127; identical to SEQ ID NO: 39372

SEQ ID NO: 42889 - protein, 94 aa, Staphylococcus epidermidis VCU127; identical to SEQ ID NO: 42021

SEQ ID NO: 42890 - protein, 103 aa, Staphylococcus epidermidis VCU127
MLKKKLDFLPNKLNKYSIRRFTVGTASILVGSTLLFGIGNEAHAAEKNQESNTTANVADSDVGEAPSKEEAPSNEATNEAPSKEEAPSNEATNEAPSKEEAPS

SEQ ID NO: 42891 - protein, 135 aa, Staphylococcus epidermidis VCU127
DSDSESTSESDSESHSDSESHSDSESTSESDSESHSDSESDSDSESTSESDSESHSDSESHSDSESTSESDSESHSDSESDSDSESTSESGSESHSNSELPDTGEEDNHQGLIGGVLAAFGGLTLLGRRRKKEEK

SEQ ID NO: 42892 - protein, 827 aa, Staphylococcus epidermidis VCU127; identical to SEQ ID NO: 41959

SEQ ID NO: 42893 - protein, 681 aa, Staphylococcus epidermidis VCU127
MTNNNRIKRFSIRKYAVGVVSIITGVTIFIGGQQAQAAETSVQHADAHPEDSQTTQQLKNDKVEETLKASKQVNADSQQVQTIDQSKTNQNNQHSVAESAQLKSDETANQPKKEESSSVKQDVQPSKNVNQQDVATQSNERENNDIKGEGQTSKTSNQHIQTSNSHNQSTGTKDSDSEEIDQPLVKLQKPSNDSTYQTQSKTKQDSSKQLPQEKTTKRQIQTTENEQTTKVDSKKANDTQNVEKHTQEPKNDTSTSQKNHHQVATKEQSNRSTTRKTQKQSSNANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRTIGKDVNKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42894 - protein, 327 aa, Staphylococcus epidermidis VCU127; identical to SEQ ID NO: 42612

SEQ ID NO: 42895 - protein, 235 aa, Staphylococcus epidermidis VCU127; identical to SEQ ID NO: 41955

SEQ ID NO: 42896 - protein, 1720 aa, Staphylococcus epidermidis VCU127
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGGKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQLNAVKKNNTKTILEQKGNEKKSAIAQTPDATTEEKQEAVSAVSQAVTNGITHINQANSNDDVDQELSNAEQIITQTNVNVQKKSQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKVDNATTNNQIDGIVSDSRQSINAITPDTSIKRNAKNDIDIKAADKKIKIQRINDATDEEIQEANRKIEEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTYQTATTEEKEAAIQLANQKSNEARTAIQNEHSNNGVAQAKSNGIHEIELVMPDAHKKSDAKQSIDNKYNEQSNTINTTPDATDEEKQKALDKLKIAKDAGYNKVDQAQTNQQVSDAKTEAIDTITNIQANVAKKPSARVELDSKFEDLKR

SEQ ID NO: 42897 - protein, 1110 aa, Staphylococcus epidermidis VCU127
MINKKNNLLTKKKPITNKSNKYAIRKFTVGTASIVIGATLLFGLGHNEAKAEENSVQDFKDSNTDDELSDSNDQSSDEEENDVINNNQSINSDDNNQINKKEETNNNDGIEKSSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVKEDSTTSQPSGYTNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEDGKYQFDGLKNGLTYKITFETPEGYTPTLKHSGTNPALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGSDSDSDNDSDSDNDSDLGNSSDKSTKDKLPDTGANEDYGSKGTLLGTLFAGLGALLLGKRRKNRKNKN

SEQ ID NO: 42898 - protein, 434 aa, Staphylococcus epidermidis VCU127; identical to SEQ ID NO: 39380

SEQ ID NO: 42899 - protein, 219 aa, Staphylococcus epidermidis VCU127; identical to SEQ ID NO: 39379

SEQ ID NO: 42900 - protein, 71 aa, Staphylococcus epidermidis VCU127; identical to SEQ ID NO: 42045

SEQ ID NO: 42901 - protein, 728 aa, Staphylococcus epidermidis VCU127; identical to SEQ ID NO: 39721

SEQ ID NO: 42902 - protein, 324 aa, Staphylococcus epidermidis VCU127
MKDNKPNNSKLIQTYLSKKTLRYGTASALTLALYLFNSNVTVYADENTANQNQGTSPKTSQTAPTNNTENTDATAITTDQNNNDEEEYDASYELPILYVTVWLDDQGNIIKDAVEDAKTPASERQPVKIPGYQHYRTSVSDGITKFIYRKISTAQSPIVENNQQDNNTNKVVETTNQNKDEVNGKEQNQANTSVTNTQITKNEKDEDTKTLKKDKDEKESKDTKTPKKDKEKKDKEKKDIKTPKKDREEKKPVIPKSGKDEKDTKITKKDKEDEITTTSKKDNNNDVQDKLPETGKTNDIQNPALIMLLAGLGLLGLFRNKIRE

SEQ ID NO: 42903 - protein, 291 aa, Staphylococcus epidermidis VCU128; identical to SEQ ID NO: 42395

SEQ ID NO: 42904 - protein, 3692 aa, Staphylococcus epidermidis VCU128
MNLFRKQKFSIRKFNIGIFSALIATVAFLAHPGQATASELEPFQNNDTTAQSDGGLENTSQSNPISEETTNTLSEQTVPSSTENKQTQNDPHNNAQPIAINAEEAESAQTAPYTNIYENNDTSDNGLHVNQPVKHHIEAQSEDVTNHTNSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELQTTLISRVSASREINDKAQEMTDGVYDSTELTTEEKDTLVDQIENHKNEISNNIDDELTDDGVERVKEAGLHTLESDTPHPVTKPNARQVVNNKAEQQKTLIRNNHEATTEEQNEAISQVEAHSSDAIAKIGEAETDTTVNEARDNGTKLIATDVPNPTKKAEAREAVTNSANSKIKDINNNTQATLDERNDAITLVNRSKDEAIQNINTAQGNDDVTEAQNNGTNTIQQVPLTPVKRQNAIATINAKADEQKRLIQANNNATTEEKADAERKVNEALLTATQNISNAPTNRDVDQAQTMGSGIISTISPATKIKEDARAAVEAKAIAQNQQINSNNMATTEEKQDALNQVESHKQATIANINQAQSTQQVSEAKNNGINTMNQDQPNAVKKNNTKTLLEQKGNEKKSAIAQTPDATTEEKQEAVSVVSQAVTNGNNHINQANSNDDVDQALSNAEQIITHTDVNVQKKPQARQALIAKVNEKQSAINTDNEGTIEEKQKAIQSLNDAKNSADEQITQAASNQNVDNALNIGISNISKIQTNFTKKQQARDQVNQKFQEKEAELNSTPHATQDEKQDALTRLTQVKESTLNDINQAQTNQNVDTALTNGIQNIQNIQVDVRKKQEARTTINDIVQQHKQTIQNNDDATTEEKEVANNLVNVSQQNVISKIDNATTNNQIDGIVSDGRQTINAITPDTSIKRNAKNDIDGKAADRKIKIQRINDATAEEIQEANRKIEEAKIEAKDNIQHSSTRDQVNEAKTNGINKIENITPATTVKSEARQAVQNKANEQINHIQNTPDATNDEKQEAINRVSAELARVQAQINAEHTTQGVKNIKDDAITSLSRINAQVVEKESARNAIEQKSTQQTQFINDNDNATDEEKEVANNLVIARKQNALDNINSLSSNSDIENAKVTGINEIAKVLPATSVKSKAKKDIDQKLAQQINQIQTHQTATIEEKEAAIQLANQKANEARTAIQNEHSNNGVAQAKSNGIHEIELVTPDAHKKSDAKQSIDDKYNEQSNTINTTPDATDEEKQKALDKLKIAKDTGYNKVDQAQTNQQVSDAKTEAIDTITNIQANVAKKPSARMELDSKFEDLKRQINATPNATEEEKQDAIQRLNVKREEVKNLINQDRRDNDVEQHKNTGLQELETIHANPTRKSDALQELQTKFISQTELINNNKDATNEEKAEAKRLLEISKNKTITNINQAQTNNQVDNAKDNGMNEIATIIPATTIKTDAKTAIDKKAEQQVTIINGNNDATDEEKAEARKLVEKAKTEVKSNITNSDTEREVNSAKTNGLEKINNIQPSTQTKTNAKQEINDKAQEQLIQINNTPDATEEEKQEATNRVNAGLAQAIQNINNAHSTQEVNESKTHSIATIKSILPNVIKKPTAINDLTQEANNQKTLIGNDGNATDDEKEAAKQLVTQKLNEEIQKIHESTQDNQVDNVKAQAITAIKLINANAHKRQDAINILTNLAESKKSDIRANQDATTEEKNTAIQSIDDTLAQARNNINGANTNALVDENLEDGKQKLQRIVLSTQTKTQAKADIAQAIGQQRSTIDQNQNATTEEKQEALERLNQDTNGVNDRIQAALANQNVTDEKNNILETIRNVEPIVVVKPKANEIIRKKAAEQTTLINQNQDATLEEKQIALGKLEEVKNEALNQVSQAHSNNDVKIAENNGIAKISEVHPETSIKRNAKQEIEQVAQSQIDTINANNKSTNEEKSAAIDRVNVAKIDAINNIANATTTQLVNDAKNNGNTSITQILPSTAVKTNALAALATDAKNKNAIIDQTPNATAEEKEEANNKVDRLQEEADANILKAHTTEEVNNIKNQAVQNINAVQVEVIKKQNVKNQLNQFVDNQKKIIENTPDATLEEKAEANRLLQNVLTSASDEIANVVHNNEVDQALDKARPKIEAIVPQVSKKRDALNAIQEAFNSQTQEIQENQEATNEEKTEALNKINQLLNQAKVNIDQAQSNKDVDNAKTRSIQDIEQIQAHPQKKETGRHRLNEKANQQQSTIATHPNSTIEERQEASAKLQEVLKKAIAKIDKGQTNDDVEKTVVNGIAEIENILPATTVKDKAKADVNAEKEQKNIQINSNDEATTEEKLVASDNLNHVVETTNQAIEDAPDTNQVNVEKNKGIGTIRDIQPLVVKKPTAKSKIESAVEKKKTEINQTQNATDDEVREGLNQLNQIHEKAKNDVNQSQTNQQVENAEQNSLDQINNFRPDFSKKRNAVAEIVKAQQNKIDEIEQEFSATQEEKDNALQHLDEQVKEIINSINRANTDNEVDNAKTSGLNNINEYRPEYNKKKNAILKLYDVSDTQEAIINGYPDATEDELQEANSKLNKILLDAKKQIGLAHTNNEVDDIYNEVSQKMKTILPRVDTKAVARSVLNALAKQLIKTFENTPDVTHEERNDAINHVKEQLSLVFNAIEKDQKDIQVAQDELFGLNELNSIFINITQKPTARKAISDKASQLNNSINNTPYATEEERQITLNKVKAIVEDANEKIREANTDSEVLGTKSNAITLLQAISADVQVKPQAFEEINAQAEIQRERINGNSDATREEKEEALKQVDTLVNQSFITINNVNKNQEVYDTKNKTIEAIHKIKPITIIKPQALNEITNQLDAQRDLIKNNNESTLEEKASAIDKLIKTAARIAEAIDKAQTNEDVKNIKKQSIDEVSKILPVIEIKLAARNEIHQKAEVIRGLINNNEEATKEEKDVALNQLDTTLTQANLSIDQALTNEAVNRAKEIATSEINKISVITIKKPEAIAEIQELADKKLNKFKQNQEATIEEKQSAINELDQALKSAINHIHQSQNNESVSAALKESISLIDSIEIQAHKKLEAKAYIDGYSDDKINDISSRVTNEEKQIFVSKLKALINRAHKQIDEAETFVSVDTIVRNFKVEVDKLNSIVRKKAKALKEIELEADHVKQMINANLSASTRVKQNARTLINEIVSNALSQLNKVTTNKEVDELVNETIEKLKSIQLREDKILSSQRSTTSMTEKSNQCYSSENNTIKSLPETGNVDKSVPLAGVTLISGLAIMSSRKKKKDKKVND

SEQ ID NO: 42905 - protein, 688 aa, Staphylococcus epidermidis VCU128; identical to SEQ ID NO: 41926

SEQ ID NO: 42906 - protein, 728 aa, Staphylococcus epidermidis VCU128
MKNKKNSYSIRKLSVGASSIIVTSMLFIGGGSVHAAESNQLENQEQSEVSASHSIELQHKDQEIQQPENKDNKNYHSETIDKNPTIHNNDYSYHETPSTDVKSNESKQIDNQSNQPQTSMTKNDQQNPKKVAEHTTKGINAKKEETRKNENAKSLVQPQQDDKTTSEQTKMKESREQDITNEQKQLQSKDVKNAQQENQNIDQEKSQEKINLQQSSIDKAQKSSRIDGKLDHQYNKDATQSNEDTASENVSEQHITAKDAGVTRNNRGDERLNQEKSTTSSDKELKVDDIDKDLSTKESPENEKDDSRKGIKALTKNSQATTRNTATTEASKELKDQTNKVASQKEYKNHDPIILVHGFNGYASGTGPITGKGNYWGGDRLKNIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42907 - protein, 502 aa, Staphylococcus epidermidis VCU128
MKDTTKPTVESVADQTQEVNTEIEPIKIEAKDNSGQAVTNKVEGLPDGVTFDEATNTISGTPSEVGSYTVTVTTTDESGNSETTTFTIEVKDTTKPTVEDIADQTQEVNTEIEPIKIEAKDNSGQAVTNKVDGLPAGVTFDEATNTISGTPTEVGKYLITITTIDKDGNTATTTLTINIIDTTAPEQPTINKVTENSTEVSGRGEPGTIVEVTFPDGNKVEGKVDSDGNYHIQVPSETTLKGGQPLQVIAIDKAGNKSETTTTTVIDTTAPEQPTINKVTENSTEVSGRGEPGTIVEVTFPDGNKVEGKVDSDGNYHIQIPSDEKFKVGQQLIVKVVDEEGNVSEPSIATVHEEDKNSEKPGTVTDTVTKNNSKSLKHKASEQQSYHNKSEKIMSVNKPTKIVEKDMSTYDYSRYSKDISNKNNKSATFEQQNVSDINNNQYSRNKVNQPVKKSRTNEINKDLPQTGEENLNKSTLFGTLVASLGALLLFFKRRKKDEDGKE

SEQ ID NO: 42908 - protein, 681 aa, Staphylococcus epidermidis VCU128
MKNNNRIKRFSIRKYAVGVVSIITGVTIFIGGQQAQAAEISVQHANAHPEDSQTTQQLKNDKVEETLKASKQGTADSQQVQRIDQSKTNQNNQHSVAESAQLKSDETANQPKVEEESSVKQDIQPSKNVNQQDVATQSNERENNDIKGEDQTSKASNQHTQSSNSHNQSIGTKDSDSEEIDQPLVKLQKPSNDSTYQTQSKAKQDSSKQLPQEKTTKHQIQTTENEQTTNVDSKKTNDTQDARQHTQEPKNDTSTSQKNHHQVATKEQSNRSTTRETQKQSANSNRNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGKELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42909 - protein, 797 aa, Staphylococcus epidermidis VCU128
MDTAQQPSHTTINSEASVQTSDNEENSRVSDFANSKIKESNTESDKEENTIEQPNKVREDSTTSQSSSYRNIDEKISNQDELLNLPINEYENKARPLSTTSAQPSSKRVTVNQLSAEQGSNVNHLIKVTDQSITEGYDDSDGIIKAHDAENLIYDVTFEVDDKVKYGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSDQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNLALDSEGNSVWVTINGQDDMTIDSGFYQTPKYSLGNYVWYDTNKDGIQGDDEKGISGVKVTLKDENGNIISTTTTDENGKYQFDNLNSGNYIVHFDKPSGMTQTTTDSGDDDEQDADGEEVHVTITDHDDFSIDNGYYDDDSDSDSDSDSDSDSDSDSDSDSDSDSDSDSDSDSDSDSDSDSDSDSDSDSDSDSDSDSDSESDSDSDSDSASDSDSDSDSGLDNSSDKNTKDKLPDTGANEDHDSKGTLLGTLFAGLGALLVGNRRKNRKNKN

SEQ ID NO: 42910 - protein, 73 aa, Staphylococcus epidermidis VCU128
MINKKNNLLTKKKPIANKSNKYAIRKFTVGTASIVIGATLLFGLGHNEAKAEENTVQDVKDSNTDDELSDSND

SEQ ID NO: 42911 - protein, 327 aa, Staphylococcus epidermidis VCU128; identical to SEQ ID NO: 42078

SEQ ID NO: 42912 - protein, 2215 aa, Staphylococcus epidermidis VCU128
MKNKQGFLPNLLNKYGIRKLSAGTASLLIGATLVFGINGQVKAAETDNTFSQNEDNKTNDSKSSDEELVKSEDDQISNTSADTTLESEFEQNNNPSSIEESTNRNDEDTLSQRTSTETETDTHVKSADNQTTNETTNKNDDNATTNHTESTSDESTYQSDDLNTTQHDNSNTNQDTQSTLNPTSKESSNKDEATSSTPKESTNIEKTSLSNDTNHQTTDEVNHSDSNNMTNSTPNDIENELDTTQLTSHDESPSPQSDNFTGFTNLMATPLNLRNDNSRINLLAATEDTKPKTYTKPNNSEYSYLLNDLGYDATTVKENSNLRHAGISQSQDNTGSVIKLNLTKWLSLQSNFVNGGKVNLSFAQSDFYTQIESITLSGVKMDTTNNGQNWSAPINGSTVNSGEIGSVTNHEILITLKNSQTLSSLGYSNNRPVYLTHTWTTNDGAIAEESIQVASITPTLDSKAPNTTQKSGFTAGRVINKIKYDSSQKSIKSVHTFKPNENFLQTDYRAVLYVKEQVNKELIPYIDPNSVKLYVSDPDGKPISQDRYVNGSIDNDGLFDSSKINEISIKNNNTSDQLSNARTSLDKNVFFGTLGQSRSYTISYKLKDGYTLESIASKVSARETFDSWMEVDYLDSYDSGAPNKRLFGSYASSYIDMIDRIAPVAPKANNITTEDTSIKGTAEADTNINLTFSDGRTLNGKVDTNGNFSITIPSDYVLTGKETIKITSIDKGDNVSPAITISVIDKTPPAVKAISNKTQEVNTAFNPFIIEATDNSGDKVMHDVRGLPAGVTFNNSSNMISGTPTDVGLYTVTVISRDVKGNETETSFKINVVDTTKPTVESVADQTQEVNTEIEPIKIEATDNSGQTVMNKVEGLPDGVTFDEATNTISGTPSEVGSYTVTVTTTDESGNATETTFTINVEDTTKPTVESVADQTQEVNTEITPIKIEARDNSGQAVTNKVEGLPDGVTFDEATNTISGTPNEVGSYDIKVTTTDESGNATETTFTINVEDTTKPTVEDIADQTQEVNTEITPITIESEDNSGQVVTNKVEGLPDGVTFDEATNTISGTPSEVGRYDITVTTTDESGNATETTFTIDVEDTTKPTVESVADQTQEVNTEIEPIKIEATDNSGQAVTNKVDGLPAGVTFDETTNTISGTPSEVGSYDITVTTTDESGNSETTTFTIDVKDTTKPTVESVADQTQEVNTEIEPIKIESEDNSGRAVMNKVEGLPDGVTFDEATNTISGTPSEVGSYDIKVTTTDESGNVTETTFTIDVEDTTKPTVEDIADQTQEVNTEITPIKIEARDNSGQAVTNKVDGLPAGVTFDEATNTISGTPSEVGSYDVTVTTTDESGNATEITFTINVEDTTKPTVEDIADQTQEVNTEITPIKIEATDNSGQGVTNKVEGLPDGVTFDETTNTISGTPNEVGSYTVTVTTTDESGNATETTFTIDVEDTTKPTVESIADQTQEINTEIEPIKIEATDNSGQAVTNKVDGLPAGVTFDETTNTISGTPSKVGSYDITVTTTDESGNSETTTFTINVEDTTKPTVESVADQTQEVNTEIEPIKIEAKDNSGQAVTNKVDGLPAGVTYDEVTNTISGTPSEVGSYTVTVTTTDESGNATETTFTIDVKDTTKPTVEDIADQKQEVNTEIEPIKIEATDNSGQAVTNKVEGLPDGVTFDETTNTISGTPSETGSYTVTVTTTDESGNSETTTFTIDVEDTTKPTVESVADQTQEVNTEITPIKIEARDNSGQTVTNKVDGLPNGVTFDETTNTISGTPSEVGSYDIKVTTTDESGNETETTFTIDVEDTTKPTVKDIADQTQEVNTEIEPIKIEATDNSGQAVTNKVDGLPAGVTFDEATNTISGTPSEVGSYTVTVTTTDESGNATETTFTIDVEDTTKPTVESVADQTQEVNTEITPITIESEDNSGQAVTNKVDGLPDGVTFDEAANTISGTPSEVGSYDIKVTTTDESGNATETTFTIDVEDTSKPTVESVANQTQEVNTEITPIKIEATDNSGQTVTNKVEGLPDGVTFDETTNTISGTPSEVGSYTVTVTTTDESGNSETTTFTIDVKDTTKPTVEDIVDQTQEVNTEITPITIESEDNSGQAVTNKVEGLPDGVTFDETTNTISGTPSEVGSYTVTVTTTDESGNSETTTFTIDVEDTSKPTVESVADQTQEVNTEIEPIKIEARDNSGQAVTNKVEGLPDGV

SEQ ID NO: 42913 - protein, 393 aa, Staphylococcus epidermidis VCU128
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAITHPADQENNAPQAGAGTPGAENTPQAGGENQNQDNAVTAAGTSGEQNGGKPATSTTGQDAAQPNGPQGTSVAQPGNDASSQGHDTPQADAGTHNTEGQPAVTTGEQAGQVKPSGDSTPTGKPNTADDQGTQIKPTSNQGTTATTGETGNQKPSGQTGNTENTPNDGTQVKPNNDPAVTGTPNANEEQTGQPNATVTPGQGNDEINGATKPGEVSPKPEENNPAVTEPGTTAPGNTNQGTQVKPNNDQTATGTQGATGDQNTQQGNTEQNNQNAEPSAPGTTDQASATV

SEQ ID NO: 42914 - protein, 108 aa, Staphylococcus epidermidis VCU128
PSNGKVEKDEDRKTSKKDKEEKITKTSKKEREEKSPAIPKSDIDEKDTKITKKDKVDEITTTSKKDNNNDVQDKLPETGKSNDIQNPALIMLLAGLGLLGLFRNKIRE

SEQ ID NO: 42915 - protein, 235 aa, Staphylococcus epidermidis VCU128; identical to SEQ ID NO: 42400

SEQ ID NO: 42916 - protein, 219 aa, Staphylococcus epidermidis VCU128
MKKTLVVSSLAIGLGVVAGNAGHDAHASETTNVDKAELAQKALTNDQSLNESPVQEGAYNINFDYNGNSYHFESDGSTWSWSYESTNNATQPVQPSQSQVATQQQPVQVSAPQNEQTAQPQTKSTSASQTSSSKASSGSSVNVNSHLQQIAQRESGGDIHAINPSSGAAGKYQFLQSTWDSVAPSQYKGVSPAKAPESVQDKAAVKLYNTGGPGHWVTA

SEQ ID NO: 42917 - protein, 434 aa, Staphylococcus epidermidis VCU128; identical to SEQ ID NO: 39380

SEQ ID NO: 42918 - protein, 688 aa, Staphylococcus epidermidis VCU129; identical to SEQ ID NO: 42441

SEQ ID NO: 42919 - protein, 235 aa, Staphylococcus epidermidis VCU129; identical to SEQ ID NO: 42334

SEQ ID NO: 42920 - protein, 291 aa, Staphylococcus epidermidis VCU129; identical to SEQ ID NO: 42332

SEQ ID NO: 42921 - protein, 219 aa, Staphylococcus epidermidis VCU129; identical to SEQ ID NO: 42003

SEQ ID NO: 42922 - protein, 434 aa, Staphylococcus epidermidis VCU129; identical to SEQ ID NO: 39380

SEQ ID NO: 42923 - protein, 728 aa, Staphylococcus epidermidis VCU129; identical to SEQ ID NO: 42333

SEQ ID NO: 42924 - protein, 190 aa, Staphylococcus epidermidis VCU129; identical to SEQ ID NO: 42345

SEQ ID NO: 42925 - protein, 131 aa, Staphylococcus epidermidis VCU129
PILVNPITGEKVGEGKSTEKVTKQPVDEIVEYGPTKAEPGKPAEPGKPAEPGKPAEPGTPAEPGKPAEPGTPAQSGAPEQPNRSMHSTDNKNQLPDTGENSQANEGTLVGSLLAIVGSLFIFGRRKKGNEK

SEQ ID NO: 42926 - protein, 994 aa, Staphylococcus epidermidis VCU129
MINKKNNLLTKKKPIANKSNKYAIRKFTVGTASIVIGATLLFGLGHNEAKAEENTVQDVKDSNTDDELSDSNDQSSNEEKNDVINNSQSINTDDDNQINKKEETNSNDAIENRSKDITQSTTNVDENEATFLQKTPQDNTQLKEEVVKEPSSVESSNSSMDTAQQPSHTTINSEASIQTSDNEENSRVSDFANSKIKEINTESDKEENTIEQPNKVREDSTTSQPSSYRNIDEKISNQDELLNLPINEYENKARPLSTTSAQSPIKRVTVNQLAAEQGSNVNHLIKVTDQSITEGYDDSDGIIKAHDAENLIYDVTFEVDDKVKSGDTMTVNIDKNTVPSDLTDSFAIPKIKDNSGEIIATGTYDNTNKQITYTFTDYVDKYENIKAHLKLTSYIDKSKVPNNNTKLDVEYKTALSSVNKTITVEYQKPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTASYDNTIAFSTSSGQGQGDLPPEKTYKIGDYVWEDVDKDGIQNTNDNEKPLSNVLVTLTYPDGTSKSVRTDEEGKYQFDGLKNGLTYKITFETPEGYTPTLKHSGTNPALDSEGNSVWVTINGQDDMTIDSGFYQTPKYSLGNYVWYDTNKDGIQGDDEKGIPGVKVTLKDENGNIISTTTTDENGKYQFDNLNSGNYIVHFDKPSGMTQTTTDSGDDDEQDADGEEVHVTITDHDDFSIDNGYYDDESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGLDNSSDKNTKDKLPDTGANEDHDSKGTLLGALFAGLGALLLGKRRKNRKNKN

SEQ ID NO: 42927 - protein, 705 aa, Staphylococcus epidermidis VCU129
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTLPADQENNAPQAGGGTPGAENTPQAGGENHNQDNAVTAAGTSGEQNGGKPATSTTGQDAAQPNGPQGTSVAQPSNDASSQGHDTPQADAGTHNTEGQPAVTTGEQAGGKPAATKPEGADTETAPVPNTADENHAQPSPQSGGTTATQAGQVKPSGDSTPTGKPNTADDQGTQIKPTSNQGTTATTGETGNQKPSGQTGNTENTPNNGTQVKPINNPAVTGTPNANEEQTGQPNATVTPGQGNDEINGATKPGEVSPKPEENNPAVTEPGTTAPGNTNQGTQVKPNPDQNNNPTTGQDTDQTDQGTQVKPNNDQTATGTQGATGDQNTQQGNTEQNNQNAEPSAPGTTDQAGATVKPGSAPNQDAEVKPNPDQNNNPTTGQDADQTGQSTQVKPNNDQTATGTQGATGDQNTQQGNTEQNNQNAEQGNTGQEGSNPNQSAQLGATVKPGSAPTQDTEVKPNPDQNNNPTTGQDADQTGQGTQVKPNNNQTATGTQGATGDQNTQQGNAGNKGNAGNKGNAGNKGNAGNKGNAGNKGNTGNADKDAKVNTNDDETKTDVKNGTELPETGLSNEYDYTTTVFGSIALISSLLLLRRQRKESK

SEQ ID NO: 42928 - protein, 327 aa, Staphylococcus epidermidis VCU129; identical to SEQ ID NO: 42429

SEQ ID NO: 42929 - protein, 681 aa, Staphylococcus epidermidis VCU129; identical to SEQ ID NO: 42440

SEQ ID NO: 42930 - protein, 2124 aa, Staphylococcus epidermidis VCU129
MNLFRKQKFSIRKFNIGIFSALIATVAFLAHPGQATASELEPFQNNDTTAQSDGGLENTSQSNPISEETTNTLSEQTVPSSTENKQTQNDPHHNAQPIAINAEEAESAQTAPYTNIYENNDTSDNGLHVNQPVKHHIEAQSEDVTNHTNSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDTGDPKNSQAIENVVALGRIHGNDVNDHGDFNGIEKEFNVNPNSELIFSFNTMTARNYKGGTNLVLRNAENNQEIATADVQGGGIYRLFKLPDNVYRIKVQFLPNNELMRDARRIYQLQDGYKYYSFIDTVGINSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLSRSSQDVARFLPNKVLNIRYKLRPVNISTPREVTFNEAIKYKTFSEYYINTTDNTVTGQQTPFSINVIMNKDDLSEQVNKDIIPSNYTLASYNKYNKLKERAQNVLDEETNNTPFNQRYSQTQIDDLLHELQTTLISRVSASREINDKAQEMTDGVYDSAELTTEEKDTLVDQIENHKNEISNNIDDELTDDGVERVKEAGLHTLESDTPHPVTKPNARQVVNNKAEQQKTLIRNNHEATTEEQNEAISQVEAHSSDAIAKIGEAETDTTVNEARDNGTKLIATDVPNPTKKAEAREAVTNSANSKIKDINNNTQATLDERNDAITLVNRSKDEAIQNINTAQGNDDVTEAQNNGTNTIQQVPLTPVKRQNAIATINTKADEQKRLIQANNNATTEEKADAERKVNEALLTATQNISNAPTNRDVDQAQTTGSGIISTISPATKIKEDARAAVEAKAIAQNQQINSNNMATTEEKQDALNQVEAHKQATITNINQAQSTQQVSEARNNGINTINQDQPNAVKKNNTKTLLEQKGNEKKSAIAQTPDATIEEKQEAVSVVSQAVTNGNNHINQANSNDDVDQALSNAEQIITHTDVNVQKKPQARQALIAKVNEKQSAINTDNEGTIEEKQKAIQSLNDVKNSADEQITQAASNQNVDNALNIGISNISKIQTNFTKKQQARDQVNQKFQEKEAELNSTPHATHDEKQDALTRLTQVKESILNDINQAQTNQNVDTALTNGIQNIQNIQVDVRKKQEARTTINDIVQQHKQTIQNNDDATTEEKEVANNLVNVSQQNVISKIDNATTNNQIDGIVSDGRQTINAITPDTSIKRNAKNDIDGKAADRKIKIQRINDATAEEIQEANRKIEEAKIEAKDNIQHSSTRDQVNEAKTNGINKIENITPATTVKSEARQAVQNKANEQINHIQNTPDATNEEKQEAINRVSAELARVQAQINAEHTTQGVKNIKDDAITSLSRINAQVVEKESARNAIEQKSTQQTQFINDNDNATDEEKEVANNLVIARKQNALDNINSLSSNSDIEIAKVTGINEIAKVLPATSVKSKAKKDIDQKLAQQINQIQTHQTTTIEEKEAAIQLANQKANEARTAIQNEHSNNGVAQAKSNGIHEIELVTPDAHKKSDAKQSIDDKYNEQSNTINTTPDATDEEKQKALDKLKIAKDAGYNKVDQAQTNQQVSDAKTEAIDTITNIQANVAKKPSARMELDSKFEDLKRQINATPNATEEEKQDAIQRLNVKREEVKNLINQDRRDNDVEQHKNTGLQELETIHANPTRKSDALQELQTKFISQTELINNNKDATNEEKAEAKRLLEISKNKTITNINQAQTNNQVDNAKDNGMNEIATIIPATTIKTDAKTAIDKKAEQQVTIINGNNDATDEEKAEARKLVEKAKTEVKSNITNSDTEREVNSAKTNGLEKINNIQPSTQTKTNAKQEINDKAQEQLIQINNTPDATEEEKQEATNRVNAGLAQAIQNINNAHSTQEVNESKTHSIATIKSILPNVIKKPTAINDLTQEANNQKTLIGNDGNATDDEKEAAKQLVTQKLNEEIQKIHESTQDNQVDNVKAQAITAIKLINANAHKRQDAINILTNLAESKKSDIRANQDATTEEKIRQYNL

SEQ ID NO: 42931 - protein, 728 aa, Staphylococcus epidermidis VCU144
MKNKKNSYSIRKLSVGASSIIVASMLFIGGGSVHAAESNHLENQEQSEVSASHSIEMQHKNQETQQPENKDNKTNHSETIDKTPTIHNNGYSYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDIKNAQQENQNIDQEKSQEKIKVQQSNIEKAQKSSRIDGKLDNQYNKDATQSNEGTASENVSEQHITAKDAGVTRNNRGDERLNQEKPTTSSDKELKVDDIDKDLSTKESPENEKDDSRKGIKAITKNSQATTRNTATTEASKELKDQTNKVASQKEYKNHDPIILVHGFNGYASGTGPVTGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIHRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42932 - protein, 656 aa, Staphylococcus epidermidis VCU144
MNNRDKLQKFSIRKYAIGTFSTVIATLVFMGINTNHASADELNQNQKLIKQLNQTDDDDSNTHSQEIENNKQNSSGQTESLRSSTSQNQANARLSDQFKDTNETSQQLPTNVSDDSINQSHSEANMNNEPLKVDNSTMQAHSKIVSDSDGNASENKHHKLTENVLAESRASKNDKEKENLQEKDKSQQVHPPLDKNALQAFFDASYHNYRMIDRDRADATEYQKVKSTFDYVNDLLGNNQNIPSEQLVSAYQQLEKALELARTLPQQSTTEKRGRRSTRSVVENRSSRSDYLDARTEYYVSKDDDDSGFPPGTFFHASNRRWPYNLPRSRNILRASDVQGNAYITTKRLKDGYQWDILFNSNHKGHEYMYYWFGLPSDQTPTGPVTFTIINRDGSSTSTGGVGFGSGAPLPQFWRSAGAINSSVANDFKHGSATNYAFYDGVNNFSDFARGGELYFDREGATQTNKYYGDENFALLNSEKPDQIRGLDTIYSFKGSGDVSYRISFKTQGAPTARLYYAAGARSGEYKQATNYNQLYVEPYKNYRNRVQSNVQVKNRTLHLKRTIRQFDPTLQRTTDVPILDSDGSGSIDSVYDPLSYVKNVTGTVLGIYPSYLPYNQERWQGANAMNAYQIEELFFTRKSSKCSTFRPSNSISCRF

SEQ ID NO: 42933 - protein, 515 aa, Staphylococcus epidermidis VCU144
MKKSSKFSKDFPTRKNHYAIRKFTVGTASIIVGSFLFFGQTQAHAEQAEEFERVTTGTVDTGGQPARADQGQEGPQAGADTHNTASQPGVTGQDAPNENHAGDQNAAVTHPANQENNAPQVGAGTPGAENTPQAGGESHNQDTAVTSAGTNGEQNGGKPATSTTGQDAAQSNGPQGTSVAQPGNDASSQGHDTPQADAGTHNTEGQPAVTTGEQAGGKPAATKPEGASAETAPAPNNADENHAQPSPQTGGTTATQAGQVKPSGDSTPTGEPNKADDQGTQIKPTSNQGTTATTNETGNQKPSGQTGNTENTPNDGTQLKPNNDPAATGTPNTNGEQTGQPNATVTPGQGNEEINGASKPGEVSPKPEENNPTATEPGTTAPGNTNQDTQVKPNTDQTATGTPAGTDNQNTQQGNTEQNNQNAQPSAPGTTDQAGATVKPSTTPNQDAEVKPSTTPNQDAEVKPNPDQNNTPTNGQDGNQTGQGTQVKPNNDQTATGTQGATGNQNAEQGNTEQN

SEQ ID NO: 42934 - protein, 612 aa, Staphylococcus epidermidis VCU144
MINKKNNLLTKKKPIANKSNKYAIRKFTVGTASIVIGATLLFGLGHNEAKAEENSVQDVKDSNTDDELSDSNDQSSDEEKNDVINNNQSINNDDNNQIIKKEEMNSNDGIEKRSEDRTESTTNVDENEATFLQKSPQDNTHLTEEEVKEPSSVESSNSSIDTAQQPSHTTINREESVQTSDNVEDSHVSDFANSKIKESNTESGKEENTIEQPNKVREDSTTSQPSGYKNIDEKISNQDELLNLPINEYENKARPLSTTSAQPSIKRVTVNQLAAEQGSNVNHLIKVTDQSITEGYDDSEGVIKAHDAENLIYDVTFEVDDKVKSGDTMTVDIDKNTVPSDLTDSFTIPKIKDNSGEIIATGTYDNKNKQITYTFTDYVDKYENIKAHLKLTSYIDKSKVPNNNTKLDVEYKTALSSVNKTITVEYQRPNENRTANLQSMFTNIDTKNHTVEQTIYINPLRYSAKETNVNISGNGDEGSTIIDDSTIIKVYKVGDNQNLPDSNRIYDYSEYEDVTNDDYAQLGNNNDVNINFGNIDSPYIIKVISKYDPNKDDYTTIQQTVTMQTTINEYTGEFRTAHPMIIQLLSLQVQVKDKVTCLLKKLIKSEITYGKM

SEQ ID NO: 42935 - protein, 235 aa, Staphylococcus epidermidis VCU144
MKKTVIASTLAVSLGIAGYGLSGHEAHASETTNVDKAHLVDLAQHNPEELNAKPVQAGAYDIHFVDNGYQYNFTSNGSEWSWSYAVAGSDADYTESSSNQEVSANTQSSNTNVQAVSAPTSSESRSYSTSTTSYSAPSHNYSSHSSSVRLSNGDTAGSVGSYAAAQMAARTGVSASTWEHIIARESNGQLHARNASGAAGLFQTMPGWGSTGSVNDQINAAYKAYKAQGLSAWGM

SEQ ID NO: 42936 - protein, 64 aa, Staphylococcus epidermidis VCU144
MLKKKLDFLPNKLNKYSIRRFTVGTASILVGSTLLFGIGNEAHAAEKNQESNTTANVADSDVGE

SEQ ID NO: 42937 - protein, 784 aa, Staphylococcus epidermidis VCU144
MPSKEKSTDNSTSNPEVDSEVLDNSKQGTDNDNSSNHSEDNIVTYAEPTALTNTRSVDSPSRVSSDNSQAQKQGKNVNDSIKVNSVDTDKEYVEPNNGQGFSTNVSFEVDGKVNKGDYFTVDMPEYADFNGIADYKAANNKIYPTINDGEQVVANGVYDTETKKLVYTFTDYVNKKDNIKGQFEIPQFIDRKNAKTSGDYDLNYNIADKTVSKPMKIVYNNYDEGHVVANTSSLITKADLFNVGSHDYTQYIYVNPKSEDSYNTRLTIQGYQEDVNDSSTLLNPDDTKIEILDAKSSDNIVPSFHINDEDFEDVTGNFGINQKGDKKAQIDFGHIDHPYIVKVTSKIDPSSSQDLRTRVIMENENAEGTTDFYAHDNTVERLGANGVATGNEKLYNLGDYVWEDTNKNGIQDEDEHGIEGVEVSLTRPNGTVETTTTNSEGKYEFNDLQNGDYVINFKTPEGYTATKAYEGNNAEVDSNGLSTVGTIKDADNWTLDSGFYKTPSKYSLGDYVWYDSNKDGYQDNDEKGIKGVKVTLKDSEGNTLKTTETDENGKYRFDDLDSGDYTVHFDKPEGLTQTSVNSGNDDAKDADGEDVHVTITDHDDFTIDNGYFEDSESDSSSESESDSESHSDSESHSDSESTSESDSESHSDSESTSESDSESHSDSESDSDSESTSESDSESHSDSESHSDSESTSESDSESHSDSESDSDSESTSESDSESHSDSESDSDSESTSESGSESHSNSELPDTGEEDNHQGLIGGVLAAFGGLTLLGRRRKKEEK

SEQ ID NO: 42938 - protein, 219 aa, Staphylococcus epidermidis VCU144; identical to SEQ ID NO: 39379

SEQ ID NO: 42939 - protein, 1616 aa, Staphylococcus epidermidis VCU144
MNLFRKQKFSIRKFNIGIFSALIATVAFLAHPGQATASELEPSQNNDTTAQSDGGLENTSQSNPISEETTNTLSGQTVPSSTENKQTQNVPNHNAQPIAINTEEAESAQTASYTNINENNDTSDDGLHVNQPAKHHIEAQSEDVTNHTNSNHSNSSIPENKATTESSSKPKKRGKRSLDTNSGNDTTSTTQNTDPNLSNTGPNGINTVITFDDLGIKTSTNRSRPEVKVVDSLNGFTMVNGRKVGLLNSVLERTSVFDSADPKNYQAIDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRIQQLHDGYRYYSFIDTIGVNSGSHLYVKSRQVNKNVKNGKEFEVNTRIENNGNFAAAIGQNELTYKVTLPENFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKCNKLKERAQTVLDEETNNTPFNQRYSQTQIDDLLHELQTTLINRVSASREINDKAQEMTDAVYDSTELTTEEKDTLVDQIENHKNEISNNIDDELTDDGVERVKEAGLHTLESDTPHPVTKPNARQVVNNRADQQKTLIRNNHEATTEEQNEAIRQVEAHSSDAIAKIGEAETDTTVNEARDNGTKLIATDVPNPTKKAEARAAVTNSANSKIKDINNNTQATLDERNDAIALVNRSKDEAIQNINTAQGNDDVTEAQNNGTNTIQQVPLTPVKRQNAIATINAKADEQKRLIQANNNATTEEKADAERKVNEAVITANQNITNATTNRDVDQAQTTGSGIISAISPATKIKEDARAAVEAKAIAQNQQINSNNMATTEEKEDALNQVEAHKQAAIATINQAQSTQQVSEAKNNGINTINQDQPNAVKKNNTKTILEQKGNEKKSAIAKTPDATTEEKQEAVSAVSQAVTNGITHINQANSNDDVDQELSNAEQIITQTNVNVQKKPQARQALIAKTNERQSTINTDNEGTIEEKQKAIQSLNDAKNLADEQITQAASNQNVDNALNIGISNISKIQTNFTKKQQARDQVNQKFQEKEAELNSTPHATQDEKQDALTRLTQAKETALNDINQAQTNQNVDTALTSGIQNIQNTQVNVRKKQEAKTTINDIVQQHKQTIQNNDDATTEEKEVANNLVNASQQNVISKVDNATTNNQIDGIVSDGRQSINAITPDTSIKRNAKNDIDIKAADKKIKIQRINDATDEEIQEANRKIDEAKIEAKDNIQRNSTRDQVNEAKTNGINKIENITPATTVKSEARQAVQNKANEQINHIQNTPDATNEEKQEAINRVSAELARVQAQINAEHTTQGVKTIKDDAITSLSRINAQVVEKESARNAIEQKATQQTQFINNNDNATDEEKEVANNLVIATKQKSLDNINSLSSNNDVENAKVAGINEIANVLPATAVKSKAKKDIDQKLAQQINQIQTHQTATTEEKEAAIQLANQMKQEQQFKMNIVTMVSHKLNLTAFMKLN

SEQ ID NO: 42940 - protein, 291 aa, Staphylococcus epidermidis VCU144; identical to SEQ ID NO: 41958

SEQ ID NO: 42941 - protein, 681 aa, Staphylococcus epidermidis VCU144
MTNNNRIKRFSIRKYAVGVVSIITGVTIFIGGQQAQAAETSVQHADAHPEDSQTTQQLKNDKVEETLKASKQGTADSQQVQTIDQSKTNQNNQHSVAESAQLKSDETANQPKKEEGSSVKQDVQPSKNVNQQDVATQSNERENNDIKGEGQTSKTSNQHIQSSNSHNQSTGTKDSYSEEIDQPLVKLQKPSNDSTYQTQSKTKQDSSKQLPQEKTTKRQIQTTENEQTTKADSKKANDTQNVEKHTQEPKNDTSTSQKNHQKVATKEQSNRSTTRETQKQSANVNQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYLDYAERVSKSKIWNTEDQAVNDLTTQGAEKINQQTSLNPNIVYTTYTGSATHTGPLGNELPNSSEILLLNLTSRIIGKDVNKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 42942 - protein, 327 aa, Staphylococcus epidermidis VCU144; identical to SEQ ID NO: 42020

SEQ ID NO: 42943 - protein, 688 aa, Staphylococcus epidermidis VCU144; identical to SEQ ID NO: 41949

SEQ ID NO: 42944 - protein, 583 aa, Staphylococcus epidermidis VCU144
KGISGVKVTLKDEKGNIISTTTTDENGKYQFDNLDSGNYIIHFEKPKGMTQTTANSGNDDEKDADGEDVRVTITDHDDFSIDNGYFDDDSDSDSDADSDSDSDSDSDADSDSDADSDSDSDSDSDSDSDSDSDSDSDSDSDSDSDADSDSDSDSDSDADSDSDADSDSDSDSDSDADSDSDADSDSDSDSDSDADSDSDSDSDSYADSDSDSDSDSDSDSDSDSDSDSDSDSDSDSDSDSDSDSDSDSDSDSDADSDSDSDSDSDSDSDSDADSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDADSDSDADSDSDSDSDSDADSDSDSDSDSDSDSDSDSDSDSDSDSDSDSDSDSDSDSDSDADSDSDADSDSDADSDSDSDSDSDSDSDSDSDSDSDSDSDSDSDSDSDADSDSDSDSDSDADSDSDSDKNAKDKLPDTGANEDHDSKGTLLGTLFAGLGALLLGRRRKKDNKEK

SEQ ID NO: 42945 - protein, 434 aa, Staphylococcus epidermidis VCU144; identical to SEQ ID NO: 39380

SEQ ID NO: 42946 - protein, 219 aa, Staphylococcus epidermidis W23144; identical to SEQ ID NO: 42003

SEQ ID NO: 42947 - protein, 405 aa, Staphylococcus epidermidis W23144; identical to SEQ ID NO: 42402

SEQ ID NO: 42948 - protein, 54 aa, Staphylococcus epidermidis W23144
MKKTRKKLDFLPNKLNKYSIRKFTVGTASILVGATLIFGAGHNVAEATEEDGST

SEQ ID NO: 42949 - protein, 928 aa, Staphylococcus epidermidis W23144; identical to SEQ ID NO: 42399

SEQ ID NO: 42950 - protein, 52 aa, Staphylococcus epidermidis W23144
KDVDKDHSDKEALPQTGEQSNSNNATLFGSLFAGLGSLFLFGRRRKKDADNK

SEQ ID NO: 42951 - protein, 434 aa, Staphylococcus epidermidis W23144; identical to SEQ ID NO: 42518

SEQ ID NO: 42952 - protein, 781 aa, Staphylococcus epidermidis W23144
MKKSSKFSKDFPTRKNHYAIRKFTVGTASIIVGSFLFFGQTQAHAEEFERVTTGTVDTGGQPARADQGQEGPQAGADTHNTASQPGATGQDAPNENHAGDQNAAVTLPADQENNAPQAGAGTPGAENTPQAGGENHNQDNAVTAAGTSGEQNGGKPATSTTGQDAAQPNGPQGTSVAQPSNDASSQGHDTPQADAGTHNTEGQPAVTTGEQAGGKPAATKPEGADTETAPVPNTADENHAQPSPQSGGTTATQAGQVKPSGDSTPTGKPNTADDQGTQIKPTSNQGTTATTGETGNQKPSGQTGNTENTPNNGTQVKPNNNPAVTGTPNANEEQTGQPNATVTPGQGNDEINGATKPGEVSPKPEENNPAVTEPGTTAPGNTNQGTQVKPNPDQNNNPTTGQDTDQTGQSTQVKPNNDQTATGTQGATGDQNTQQGNTEQNNQNAEQGNTGQEGSNPNQSAQLGATVKPGSAPTQDTEVKPNPDQNNNPTTGQDADQTGQGTQVKPNNNQTATGTQGATGDQNTQQGNTEQNNQNAEPSAPGTTDQAGATVKPGSAPNQDTEVKPNPDQNNNSPTGQDADQTGQGTQVKPNNDQTATGTQGATGDQNTQQGNTEQNSQNAEQGNTGQEGSNPNQSGQLGATVKPGSATNQDTEVKPNPDQNNKPTTGQDADQTGQSTHVKPNNNQTATGTQDAIGDQNTQQGNAGNKGNAGNKGNAGNKGNTDKDAKVNTNDDETKTDVKNGTELPETGLSNEHDYTTTVFGSIALISSLLLLRRQRKESK

SEQ ID NO: 42953 - protein, 291 aa, Staphylococcus epidermidis W23144; identical to SEQ ID NO: 42395

SEQ ID NO: 42954 - protein, 653 aa, Staphylococcus epidermidis W23144
MNLFRKQKFSIRKFNIGIFSALIATVAFLAHPGQATASELEPSQNNDTTAQSDGGLENTFQSNPISDETTNTLSEQTVPSSTENKQTQNDPHHNNQPIAINAEEAESAQTPPYTNIYENNDTSDNGLHVNQPVKHHIEAQSEDVTNHTNSNHSNSSIPENKATTESSSKPKKRGKRSLDTNSGNDATSTTQNTDPNLSNTGPNSINTVITFDDLGIKTSTNRSRPEVKVVDSLNGFTMVNGGKVGLLNSVLERTSVFDSADPKNYQAVDNVVALGRIKGNDPNDHDGFNGIEKEFSVNPNSEIIFSFNTMTAKNRKGGTQLVLRNAENNQEIASTDIQGGGVYRLFKLPDNVHRLKVQFLPMNEIHSDFKRTQQLHDGYRYYSFIDTIGVNSGSHLYVKSRQVNKNVKNGKEFEVNTRIENNGNFAAAIGQNELTYKVTLPDNFEYVDNSTEVSFVNGNVPNSTVNPFSVNFDRQNHTLTFSSNGLNLGRSAQDVARFLPNKILNIRYKLRPVNISTPREVTFNEAIKYKTFSEYYINTNDNTVTGQQTPFSINVIMNKDDLSEQVNKDIIPSNYTLASYNKYNKLKERAQTVLDEETNNTPFNQRYSQTQIDDLLHELLTTLISRVSASREINDKAQEMTDGVYDSTELTTE

SEQ ID NO: 42955 - protein, 334 aa, Staphylococcus epidermidis W23144
MKRGVTILNWQRKCILTTLLVLSSLFLVFSTITYASERDYKDSLKITTHNVYFLPTAIYPNWGQSQRADLISKADYIQNQDVVILNELFDKKASKRLLARLHSQYPYQTPIVGKGTEGWQNTSGTYRKIKKVSGGVGIVSKWPIVQQEQHIYKKGCGADMAGNKGFAYIKINKNGKYHHIIGTHLQAEDSTCFKGKDKDIRQSQMSEIKQFIKDKNIPKNEPVYIGGDLNVIKDSDEYEQMANNLNVSLPTQFDGNAYSWDTSSNSIAKYNYPKLEPQHLDYILLDRDHAQPSSWHNDTHRVKSPEWSVKSWGKTYKYNDYSDHYPLSGYASNE

SEQ ID NO: 42956 - protein, 190 aa, Staphylococcus epidermidis W23144; identical to SEQ ID NO: 42409

SEQ ID NO: 42957 - protein, 727 aa, Staphylococcus epidermidis W23144
MKNKKNSYSIRKLSVGASSIIVASMLFIGGGSVHAAESNHLENQEQSEVSASHSIELQHKDQEIQQPENKDNKNYHSETIDKNPTIHNNDYSYHETPSTDVKSNEGKQIDSQSNQPQTSMTKNDQQNPKKIGEHATNGINAKKEETRKNENAKSLVKPQQDDKTTSEQTKMKESREQEITNEQKQLQSKDVKNAQQENQNIEQEKSQEKINLQQSSIEKVQKSSRIDGKLDHQYNKDATQSNEDTVSENVSEQHITAKDEGVTRNNRGDERLNQEKSTTSDKELKVDDIDKDLSTKESPENEKDDSRKGIKALTKNSQATTRNTATTEASKELKDQTNKVASQKEYKNQDPIILVHGFNGYASGTGPITGKGNYWGGDRLKIIQDYRAKGYNVMEASVSAFGSNYDRAVELYYYIKGGRVDYGAAHAAKYGHERYGKTYAGAYKDWKPGQKIHLIGHSMGGQTIRYLEELLRHGSPEEVEYQKQHGGDISPLYKGGQDNMISSITTIATPHNGTHAADLLGNEEIIRQVAYDYARSKGNKLSHVDVGLSQWGLKQREDETLVQYIQRVKQSKLWTTKDNGFYDLTTEGTDILNQKTSLNPNIVYKTYQGESTRPGPNGTQKADVNMNIGYTLTANTIGKVKDKAWRENDGLVSVISGQYPLNQAHTSATDQVQKGVWQVTPVKHNWDHGDFVGTDTSEVRISKEELEDFWDNMFEDMVRNEKVTDKQ

SEQ ID NO: 42958 - protein, 688 aa, Staphylococcus epidermidis W23144
MKTRQNKYSIRKFSVGASSILIAALLFMGGGSAQAAEQQQDKGTVENSTTQSIGDKNEKLSEQQSTQNKNVNEKSNVNSITENENLHNETPKNEDLIQQQKDSQNDNKSESVVEQNKKNEAFVQNHSEEKPQQEQVELEKHASENNQTLHSNAAQSNEDVKTKPSQLDNTTAQQEDSQKENLSKQDTQSSKNTDLLRTTGQNQSKDSQSTEEVNKEVNNDTQQVTAKKDDDKVETFNLNSKEEPLKVDKQANPTTDKDKSSKNDKGSQDGLANLESNAVATTNKHSKQQVSEKNEDQTNKSAKQKQYKNNDPIILVHGFNGFTDDINPSVLTHYWGGDKMNIRQDLEENGYEAYEASISAFGSNYDRAVELYYYIKGGRVDYGAAHAAKYGHERYGKTYEGVYKDWKPGQKIHLVGHSMGGQTIRQLEELLRHGNPEEVEYQKQHGGEISPLFQGGHDNMVSSITTLGTPHNGTHASDLLGNEAIVRQLVYDVGKMYGNKDTRVDFGLEHWGLKQKPNESYIQYVKRVQNSKLWKSEDSGLHDLTRDGATDLNRKTSLNPNIVYKTYTGESTHKTLAGKQKADLNMFLPFTITGNLIGKAKEKEWRENDGLVSVISSQHPFNQKYVEATDKNQKGVWQVTPTKHDWDHVDFVGQDSTDTKRTRDELQQFWHGLADDLVQSEQLTSTNK

SEQ ID NO: 42959 - protein, 235 aa, Staphylococcus epidermidis W23144; identical to SEQ ID NO: 42400

SEQ ID NO: 42960 - protein, 218 aa, Staphylococcus equorum
  subsp. equorum Mu2
MKKTVIASTLALGLGVTGAAGNSADASEQNVDKAQLAQLAQSNPEQLNEAPVQEGSYDIDFNYNGTEYSFESDGTNFSWSFGGGSAEGSTEAPAQQEAPAEQAAEPAQQSAPKTEATQQPQQESTSKESSSSEASSGSSVNVNSHLQAIAQRESGGDITAINPSSGAAGKYQFLQSTWDSVAPAAYQGVSPASAPESVQDAAAVKLYNTAGASQWVTA

SEQ ID NO: 42961 - protein, 434 aa, Staphylococcus equorum
  subsp. equorum Mu2
MPIITDVYAREVLDSRGNPTVEVEVLTESGAFGRALVPSGASTGEHEAVELRDGDKDRYLGKGVIKAVENVNEIIAPELVEGEFSVLEQVSIDKMMIQLDGTENKGKLGANAILGVSLAVARAAADLLGQPLYKYLGGFNGTQLPVPMMNIVNGGSHSDAPIAFQEFMVLPVGAETFKESLRWGAEIFHNLKSILKNRGLETSVGDEGGFAPKFEGTEDAVETILEAIKAVGLEPGKDVFLGFDCASSEFFEDGVYNYVKFEGENGKKRNAEEQVDFLEELVNKYPIISIEDGMDENDWDGWKVLTERIGDRVQLVGDDLFVTNTVKLEEGIEKGIGNSILIKVNQIGTLTETFEAIEMAQKAGYTAVISHRSGETEDTSISDIAVATNAGQIKTGSLSRTDRIAKYNQLLRIEDELYETAKFDGLKSFYNLSK

SEQ ID NO: 42962 - protein, 236 aa, Staphylococcus equorum
  subsp. equorum Mu2
MKKTVIASTLAVGLGVTGAAAGNSADASEQGIDKADLAQQAQSNSEQLNQAPIQEGSYNHNFTQDGVNYNFQSDGTNFTWSYGEGSNGSSEQASTNSGQQQAQPQQEQAQQATAEQPTEQSAPQTEETQQPQQEAASTQSSESSNESSSSEASSGSSVEVNSHLQAIAERESGGDLKAVNPSSGAAGKYQFLQSTWDSVAPEEYQGQSPTEAPESVQDQAAMDLYESEGASQWVTA

SEQ ID NO: 42963 - protein, 1426 aa, Staphylococcus equorum
  subsp. equorum Mu2
MKSKQGFLPNKMNKYSIRKFTVGTASLLIGATLVFGVGSEAQAAELDAITTNDSGSNKGVALDISDIKSIETETQNVENGTISNANDVKDTEGKEENPDIDTSKLERENTEKVQESKNVVETTKENTNIEPSTDNKNQEINEKDTIENNVIEEEKPTNEKVESENTEITNISENTDTLKTEEKTNDEKNTSEPKTTDENKPEMTEQKTKIEEASQQPTEPINEKVQPEQEIILDQTEMENGDNVNDEITPTEQTSNEQTPTDKSTADSVLIQQLSTTTDKEAEVKTFLNSELSEEETKSIIDQTNINFEKASNEEIKNEILKALAIQLANEQDANTILATPKKTVLRAMAAPTAITTADATNEQVDKSLGYVDNYTFASLIFDPKTLSSQGALDSKEIDFNIDSYMSGANSGDRYKIDLKLDPIIAKHVTKISVNPANRSKPVEFVRLTDDQGNLTNTWEVNFIRANNGLFGGAEILSQYSAENGKIYLDDTVRNIINEVGDLSNNKLNYQMFVRDSSENKIVRTTESSGYFLTNADSDLIQLQNKISTANSKSFTSSSGSAVFNSDIGNNGGIIIDQQVMKDGIFSYNTAGNKQWSYNYQIDKDLLPYIESAELHIYDYVGLAGFDKTYYASNKVADLTLDTIGNGKITSENLNDLISFNNSLPETVGMRIVLKLNQSVNNILTKEALYDSVGNLISETTKQKEDFTFAGYLTDNGGMLINNTMGTSTVALQDYDKDGLLDRYERQVSLSDAEVLDTDADGKNDGDEVVNYKTSPLVGLPVVADINMADTIVSGSVPLKAGAVSQTAKVINADNQIIGSATVNSDGSFAIVIPSSPAGEYTIAIDSPNYVNDEVSKFNIIDNTIVPTPTIDPVDDNDTVIVVHGATGSTVTVTDNHNNVIGTVKITNDTTSGSITLSTPLEAGTVLTSTASENGKISDSSKTITVTDATAPDAPIINTVTSEDTQVSGTAEPGTSVRINFPGGGYTAITTDSNGNYTIDIPDGVILEGGESITATSKDDAGNISETATTIVTDITAPETPTVEELTSEDTQVNGTAEPNSEVTVTFPDGTTATGTTDEEGNYTIDIPTNIDLVGGEEVKVVATDKDGNVSEEGTTTVTDVTAPDAPTVEEVTSEDTQVSGTAEPNSEVTVTFPDGTTVTGTTDEDGNYTVDIPEKVELEGGEEVKVVATDKDGNVSEEGTTTVTDVTAPDAPTVEEVTSEDTQVSGTAEPNSEVTVTFPDGTTVTGTTDEEGNYIIDIPENVELEGGEEITVTSTDKDGNISESTKVIVINKEETPNAGETPNAGETPKTEQTASIGEKSNTNEASSKEETQSKSQNIMSQENSTIEKTNSNSTVNKNTTNSSINKGESKRAHSNKLNSENELPETGQDETRNRTLFGTLIAGLGGLLLLVMRRRKKEEDENKMS

SEQ ID NO: 42964 - protein, 226 aa, Staphylococcus equorum
  subsp. equorum Mu2
MKKTVIASTLALGLGVTGAANSADASEQGVDKAELAQLAQSNSEQLNEAPVQEGAYDIDFNYNGTDYSFESDGTNFSWSFGGGSTEAPAQQEAPAEQAAEPAQQSAPAEQAAEPAQQEAPKTEATQQPQQESTSKESSSSEASSGSSVNVNSHLQAIAQRESGGDLKAVNPSSGAAGKYQFLQSTWDSVAPAAYQGVSPTEAPESVQDAAAVKLYNEVGASQWVTA

SEQ ID NO: 42965 - protein, 1085 aa, Staphylococcus equorum
  subsp. equorum Mu2
MFNNTKRNTIYSIRKGMMGTASVTIGTCLLLGMSNQASADEHSHVKNGSETTTAQDQTSSQNHTLESPKSTPTDNHNLNNNQAANIHNQNEGTTEEPKEETTDTNKQDIKNENQSPNTQSSLNNSSDTQKPEQPTESDASEEQTIDNNAKESEESITEHDTNKDEFAEQNTQKSQQHELLKEKDKKKDSNVENSKYDQSPKSSSSEAKQEQVQKNDESKQSIDQTKNSKTSTEHSKTPTDNSNTPNEPDKSTKNSNTSADNATSTTQKQHDPANKSVNKTEDSIKPTHKIEDASTESQFASEPLNNNNENSDAISSNSTSTKKLETLTNEERATLLKAIQHDTQEQDKQPKAVLQMASAQNPTIRNTRNASKDSTSLNINHTGRYDSGAGFDKGGTEIVKYNPKNGYAYSINGDKEALDILDIKNTKNKEIQLVNRIYLQDAGIEARDLTSVAVHPNGNYIALSAPAKDKTKPGHVVFYSDTGKYLNDLTVGSLPDMVTFTKDGTRLLVANEGEPSDDYKVNPEGSVSIIDTSGVPAELNNSHVRTTPLTQEHMNESIRELGPNKSEAYLNLEPEYIVTDDSGKYAYVTIQESNTIAKLDIENGEFVQVQGLPYKDHSLPENAIDPSDKDGKKELRPVPVLGMLQPDGIDSYEYNGETYLLIANEGDSQDYEGYSEEVRVKDIKDDIELDAKYYEGYTQEELDALVANGLFDDDQLGRLKVTTSHKFRDENGKYNALVTFSGRSFSILKGSDLSMIYDSGNDIEQRIKDILPERFNANYEDFNELEVDGRSDDKGPEVESIEVGTIGNQTYAFVGLERVGGVMIYNITNPTAPEFTQYLYDEQNKDVSPEGITFVSAEDSPTGKPMLIVSFELSGTTSTFELDEIGGSEQAHPNDQDNTKNDNPPVNDGEDNDTIDSNDEKPEIEHHSEDPLVGQNSAIENPDALISETPSNVRNDSSQLNNNSTVQSADFSTAPVDAQYNNTMKNQKSVSQSEQPKHHLATETHNQNGTKYNTSINKTSTTNTILDKEDVNLDKQNASNDHSHSTEAQQLPNTGQSQSQLPLWVSLILGACLLLIGRKQRPKKK

SEQ ID NO: 42966 - protein, 186 aa, Staphylococcus equorum
  subsp. equorum Mu2
MLISTIVVFVLGLASLIGAIGTMASYGEDSNSSTETATETNSSDNSDNSSNEREPSSGSEIKKKGDTVEIDGVEFTLQGSEYINDRNEFSDVQADKVLKVNVKIKNNSDSEIPVGGDLKVYADGEEVDTYPATDIQDTLLGSVSPDRSTSGSEAYAINGNPEELELEFKPSMSFSDKRYVYELNPE

SEQ ID NO: 42967 - protein, 290 aa, Staphylococcus equorum
  subsp. equorum Mu2
MKKLDTWLEKHNLRNIPTFIVAVAFVIFVIMIIAFLNHNDENSSTIYITEDAELRTGPNAVYPEINSIKKGQNFHKIGESGKWIEVESGNNEKGWVAGWHTNLNIQADTNKNAKPLKDKIIVLDPGHGGRDQGASSNTNKHSKEKVYTLKTAKELKALLEKEGATVNMTRSSDEYVSLSDRNIKGDAYISIHNDSLKSAKANGSTVYWFKKNQKALAETLSASLQTKALLTNKGARQENFQVLRQTDVPAVLLELGYISNPTDEDMIRDQLHRQIVEKAVVDGLRAYFSE

SEQ ID NO: 42968 - protein, 926 aa, Staphylococcus haemolyticus
MGNKQGFLPNKLNKYSIRKFTVGTASLLVGTTLFFGIGSEAQAAELDTITKEDVKSQDKGEALDIKNIKESEKDVTTEDDNNAEVQNSAQTVDKSENSNDTAVESTNDSVKTDETKETSENKSAQDDDNIKEDSNTQEESTNTSSQSSEVPQTKKDTNETSETAIDEDASTKEQNNKDNDTAQDDDNIKEDSNTQEESTNTSSQSSEVPQTKKEQPDKSSNSIKEPDKQQEEVAKEEKATTEIADKNKELELKNNKTDKNEESELESNLSSSENKKDTVESFLNSQLSDSETKKIMENANIDYDKATDEEINTEILRASLIEMANNKKKTETLATPQRTMFRAMATPTALRAAVNQDEELQKSLGYTDDYTFASMLFDPGKLDSDDALNSNIIPFDLHSYMSGANSGNRYKIDLKLDPIIAEHVTKISANPSGSNKPVEFVRNKDENGNLTDTWEVNFISANDGLFGGAEILSQYTAKNGKIELDDTVGNIISNAGNLSNNKLNHQVFVRDSRENKIVRTSESSGYFLTKADDDLVNLENNVSTENNNAFKASSGSATYNENVGEFGGILIDQQIMKNGIFSYSKTKANQWAYNYQIDKDLLPYIEGVELHQYEYKGLEGFDKNYDAKNKVANLTIDEVGNGTITSDNLNKLIEFNNALPETVGVRVVLKLNQSVNNILTKDAKYDSEGNLIRETIKQKEDFTFAGYLTDSKGALINNTLGTSTLALQDYDKDGLLDRYERQVSLSDAESEDTDGDGKNDGDEVINYKTSPLVGKPQAADITTEDTVVSGSVPLKEGAATQTAKVINAEGTTVGTATVNSDGTFSVSIPNSPEGTYTIAIDSPNYDNDEVNTFEIVDNSKLPAPSINPVDDNDQQIVVNGTSGSTVTVTDSNNNVLGTVTIPADDTSAAINVDTPLEAGTVLTSTA

SEQ ID NO: 42969 - protein, 44 aa, Staphylococcus haemolyticus
MQKLAEAIAAAVSAGQDKDWGKMGTSIVGIVENGITVLGKIFGF

SEQ ID NO: 42970 - protein, 44 aa, Staphylococcus haemolyticus
MEKIANAVKSAIEAGQNQDWTKLGTSILDIVSNGVTELSKIFGF

SEQ ID NO: 42971 - protein, 44 aa, Staphylococcus haemolyticus
MSKLVQAISDAVQAQQNQDWAKLGTSIVGIVENGVGILGKLFGF

SEQ ID NO: 42972 - protein, 711 aa, Staphylococcus haemolyticus
MIKLINSYFFESISEGNTYRGDFLKNNNSKRQFSIRKFTIGVVSIVAGITFFVSEHDVQAAEQQSSHLSQESVLSHSKPSDQDANVSSKESEIDKNINKVDDAQSYSQQNEQQSSKAENKEIQNSTQAEQVEKQEQPASNQTANHSSKESSINNQESHNKQQPSDDKTPNIKPEKIEKVDNHKRIQDQYQDKNKQVDNNQSNNSQLNQKEHPNSSNNKQQKQRLDVKPQNDNQQLQSRNDVKEKLDNQPIEQKDTKLQSNNKSKDNTTSVKSHSQQHKPHSLKTQSHLTPGQKVNTNISTNPTQQQTTNQNIKPKNTDEATIKSNQYKNKYPVVLVHGFLGLVGDNAPALYPNYWGGTKFPVKKRLEKLGYDVHEASVGAFSSNYDRAVELYHYIKGGKVDYGAAHAAKTGHDRYGKFYQGIMPDWEPGKKIHLIGHSMGGQTIRLLEHFLRHGNQEEIDYQKAHGGEISPLFTGGKDNMISSITTLATPHNGTPAADKLGNTDFVKVYLIRIGRLSGNKYSHIDLGFSQWGFKQRPDESYIDYVKRVANSKIWKTQDSAVYDLTTEGSEKLNQMTSINPNIVYTSYTGLDTHTGPLGNENPNIRQFFLFDLTSRLIGRDDNVNVRKNDGIVPVSSSLFPTNQAAKTVGMTSPTTDKGIWQVKPVMNGWDHLDFVGLDATDYKRIGEELSQFYLGIINNLIRIEDIDGIKH

SEQ ID NO: 42973 - protein, 1220 aa, Staphylococcus haemolyticus
  strain JCSC1435
MLQKTKYRFSIRKFSIGTGSVLLGAFLFVGFQDVAHASELHNSTLTTDTASNPQSFEKKANNSTHEDVQNAASTYQSNPLKNTENTTKAEIQSQITSKTTHSVKENANAQAIAASSQIEKKVIHTRSRRSATSPITSEGVLEDTTTTATPNMDDANGASVKSRDVAILQPKDSNTVPTPNVVFEKSPDPNQYTFAITDLKDFNAAYQTKYYYRLSKPYDDSNDVTIELVNGETNTVVETKQINSPGTVSIGQNSLEIAVAAHDPQKAKYGHINFTFLNTLDSFKNTVSTIRARFEIDDNGSLEDRRSGIQIYDLFNQANEGTTITDPQYYVPHIVPETTYYRVVTKNNPTYQADKTDINAQTYQPDFTEKELAHYTIKGMDGQIYTASNSREFEGYKLYQIAEPNHMIGTMVRPYQVGLRYVDAETNNGGVKRIKEIIGEDGTTRIEIWTLSVDHMSESAKNTGIDTTNYVKVYEATLRPGERNKNDLGKQIYIPGYNIPFLIQPASAGEGAVGNIFAPNQSINGVQVGRGSNFRLQNLLAKAHPIIYYYTAIDPVEVTLKANKVVKGEHTLAQGEFTFNIVAGPNSPAIPETSQSKTNAADGSVTFDKISFTKPGTYTYTITENKANLNSNFDAEPLTITATVTVTEENVALNANVSYAYDSDTDNNQAFTNYYVAPKQLDFDVHFTKSLVGRPLNNEEFQFTMKNADGEVIATGTNNATGQINFNFIEGKRPTYTNADAGKTFTYTVEEVPSNLPNINSDSMKAIVTVNITKDLHVLTATSIAPADTEFNNTFVPPTPPTPVFQPEKFDLSVEKYDITANKLLDDDSELANKYADTNVNPYADQTTNNEPENINTKTLNRGDKIVYQVWLDTTHLTPENKINKLGITDDYDETSVAVQSIKVYDGITGQDVTNLFDITDENGVIIATSKDSLVKDHVLDNAQMPFGRYYKLDIVGVIKDSAKASKDITNVANQSVQFFNPAKGGNEVPPPKPSEKRVNKVKPVPVNFEFKVTKKLEGGQLKGGDYTFILTDLNTPDHPEQSATNDANGKVNFLPIKFNKVGTYIYQITEQVGTDSNIAYDTMSIKSTVVVTENPETGNLQATVTYNSSGGKSVGINDTEFNNTVKPPVPPTPNKPPHNPPKTPGQPPVNPPGNPPEKPGVPPTHHVPPTPKQLNQPKHLPNTGSDDANINKSLLATMFASLGSVLLFGRRRRDGQNLK

SEQ ID NO: 42974 - protein, 329 aa, Staphylococcus haemolyticus
  strain JCSC1435
MNKKILATAVLGTGALSTLFAHQAEASTTHTVRSGESLWSISHHYGITVSKLKSLNGLSSNLIFPNQVLKVSGSSNYSSRSNYGNSSSTYTVRAGDSLSSIASRYGTTYRHIMNLNGLNSFLIFPGQQLKVSGSVSSNSHSSYNSNSGGSSSTYTVRYGDSLSSIASRYGTTYQHIMRLNGLNNFFIYPGQKLRVSGSASSNTYSTRSAQSTYYSSPVFNHRNLYDWGQCTWHVFNRRAAIGKGISTYWWNANNWDNAAARDGYRIDGNPTVGSIAQSDAGYYGHVAFVERVNSNGSILVSEMNFSASPGILTYRTIPAYQVRNYKFIH

SEQ ID NO: 42975 - protein, 197 aa, Staphylococcus haemolyticus
  strain JCSC1435
MKNKQNKYSIRKFTVRTASILVGAALIFGSANDEAKAAEKDQVSTTTNSNEEQNVKAKGNVQTSESTTLSQVNPEQVDVTKQNVETDVDNNSSENASNNEISNETSKQESTENSSNQDVSSQEVTNENNSIETSKNSNSTETLSSEEPSQNNSAEKSISEKTTKKASTEESQSTLNSNNDATNEAKSEQPSTEETTK

SEQ ID NO: 42976 - protein, 199 aa, Staphylococcus haemolyticus
  strain JCSC1435
MYVNPLRYTANNTEVTINGTGPNGSTIIDDSTEIKIYKVADDQYLPDSNRIYDYSQYENVTNDYPISVNGDNTAPINFGDINTHYIIKVVSKYQLDSEGNVNIQQWASMVTTNKYYGTDDTAKYGNNITLATSNGNGNGDDTDSDADADADADADSEKENNELPGTGSDEKNGVILGSLFAAIGTLLLGKNRRKINDKK

SEQ ID NO: 42977 - protein, 1855 aa, Staphylococcus haemolyticus
  strain JCSC1435
MKKKSNKRLDFLPNRLNKYSIRKFTVGTASILVGATLIFGAGHDVAKAAEDTKTEEGVTSNSDESAQSSSETANTGVETTEQATAEQPTTEEKATEESTTEQPSTEEKATEESTTEQPSTEEKATEESTTEQPSTEEKATEESTTEQPSTEEKASKESTTEQPSTEEKASKESTTEQPSTEEKASKESTTEQPSTEEKASKESTTEQPSTEEKVTEESTTEQSSIEEKASKESTTEQPSTEEKVTEESTTEQSSTEEKASKESTTEQPSTEEKTSEENTTERSTVIDKDSSQSVQNISQNLGVSNEETISALSDAGVNTSNASEVDAIAALIQKDYQNNKNENPVATFSNTSSQATTNNNTRTRTLANKIRIAAAAVAEDNSKIIDADALANGYIKSQTDATNAANTLSGRAWVVDQGTPATMSNGLTSVPEGTPVYMQWIDKDGVVSPIYRAHTNNSLSTSGGSQVGPGAYAFDLRQAYTDANGKEHKYSATSGQYYKLWIEDYQTKNGNTVTMLRQAGGFFPGSYVNSVTSNNIGQFPLIGTNMQRTGIYMGVKPTSDYMTTSKDQWIHDTQGPISNAAVNTKAKNTVSGQVWLETGTGVDLANSASGPNLSGNDKVAPGYTVVMSSLTSEGVQAYKAAVDSLPESERADAAKALLSDHPEYISATVYGETDSDGRYTLRFPDGTLNDKYMYGYVVNPNGEVQNAYSSFTSPQFRSPMANSSFVPQSRPGQNLIVNPMWYNLNFALVPQNDVKIDITNYNNTTKPARPGDVAQIDLSGTQLSPLPTHIEWRDKNGNVVSKTDDITSFTDGEQKGQFTVPASAQNGDIYTVVLVTGGKDVGADSFVVGTPKDNNVYEPTTEGVDKQYGEPTTEDDVTGAVTIPDYPADKEQPTITVDDPTQLPDGNTPGTSNVDVTVTYPDGTTDHIEVPVTVGNQADNDAYEPKTEGVDKQYGEPTTEDDVTGAVTIPDYPADKEQPTITVDDPTQLPDGNTPGTSNVDVTVTYPDGTTDHIEVPVTVGNQADNDAYEPKTEEVTKDYGTPTTEDDVTGAVTIPDYPSEKGKPTITVDDPSKLPDGNTPGTSNVDVTVTYPDGTQDHVTVPVTTNPEKDNNAYEPKTEEITKDYGTPTTEDDVTGAVTIPDYPSEKGKPTITVDDPSKLPDGNTPGTSNVDVTVTYPDGTQDHVTVPVTTNPEKDNNAYEPETTPVTKEHGTPTTEDDVTGAVTIPDYPSEKGKPTITVDDPSKLPDGNTPGTSNVDVTVTYPDGTQDHVTVPVTTNPEKDNNAYEPETTPVTKEHGTPTTEDDVTGAVTIPNYPSEKGKPTITVDDPSKLPDGNTPGTSNVDVTVTYPDGTQDHVIVPVTTNPEKDNNAYEPKTEEVTKDYGTPTTEDDVTGAVTIPNYPSEKGKPTITVDDPSKLPDGNTPGTSNVDVTVTYPDGTQDHVTVPVTTNPEKDNNAYEPKTEEVTKDYGTPTTEDDVTGAVTIPDYPSEKGKPTITVDDPSKLPDGNTPGTTEVDVTVTYPDGTEDHIKVPVTVGTDTVAPDAPTVDAPEVGADTVTGTGSEPGNTITVTFPDGTTGTGTVGEDGSWSVEVPGGTELNNGDKITAVETDDAGNVSDEGSAIVVDDSDADADSDSDSDSDSDSDSDSDSDSDSDSDSDSDSDSDSDSDSDSDSDSDSDSDSDSDSDSDSDSDSDSDSDSDSDSDSDSDSDSDSDSDSDADADSDADADSDADADSDADADADSDADSDADADSDADADSDADADSDADADADSDADADSDADADADSDADADADSDADADKDHNDKADKPNNKELPDTGNDAQNNATLFGSLFAALGGLFLVGRRRKNKNNEEK

SEQ ID NO: 42978 - protein, 645 aa, Staphylococcus haemolyticus
  strain JCSC1435
MSLHKKKISLFAFFLLTVFTVTLKTYFSYYVDFSLGVKGLVQNLILLMNPYSLIALILSVFLFFKGKKAYWFIFIGGFLLSFLLYANVVYFRFFSDFLTFSTLNQAGNVESMGGAVGASFKWYDFVYFIDTIVYLFILIFKGSWLDKRVFSKKFVPVVMAASVALFFLNLAFAETDRPELLTRTFDHKYLVKYLGPYNFTVYDGVKTIQNNQQKALASEDDLTKVLNYTKQKNTTPNSEYFGAAKKKNIIKIHLESFQTFLINKKVNGKEVTPFLNKLSTGNEDFRYYPNFFHQTGQGKTSDAEFTMDNSLYGLPQGSAYSLKGDNTYQSLPAILDQKQGYTSDVMHGDYKTFWNRDQVYKHFGIDKFYDATYYDMSDDNIVNLGLKDKPFFKESAEYQSKMKGPFYSHLITLTNHYPFTLSEEDADIDKPNTGDSTVDGYIQTAHYLDQALEEYVTDLKKKGLYDDSVIMIYGDHYGISENHNNAMEKLLGEKITPAKFMDLNRTGFWLKIPGKEGTVDKTYAGQMDVMPTILHLVGIDSKNFLMFGTDMLSKDHNDVIPFRNGDFITKDYKYVNGKAYSNKTNELLETQPKDLDKNKKQVEKDLEMSDNVLNGDLFRFYKNPDFKKIDPSKYEYKTGPKGNQK

SEQ ID NO: 42979 - protein, 434 aa, Staphylococcus haemolyticus
  strain JCSC1435
MPIITDVYAREVLDSRGNPTVEVEVLTESGAFGRALVPSGASTGEHEAVELRDGDKSRYSGKGVTKAVENVNEIIAPEIVEGEFSVLDQVSIDKMMIQLDGTPNKGKLGANAILGVSIAVARAAADLLGQPLYKYLGGFNGKQLPVPMMNIVNGGSHSDAPIAFQEFMILPTGAESFKEALRWGAEIFHNLKSILSERGLETAVGDEGGFAPKFEGTEDAVETIIKAIEKAGYKPGEDVFLGFDCASSEFYENGVYDYTKFEGEHGAKRSAAEQVDYLEELIGKYPIITIEDGMDENDWDGWKQLTDRIGDKVQLVGDDLFVTNTEILSRGIEQGIGNSILIKVNQIGTLTETFEAIEMAQKAGYTAVVSHRSGETEDTTISDIAVATNAGQIKTGSLSRTDRIAKYNQLLRIEDELFETAKFDGIKSFYNLDK

SEQ ID NO: 42980 - protein, 44 aa, Staphylococcus haemolyticus
  strain JCSC1435
MSKLVQAISDAVQAGQNQDWAKLGTSIVGIVENGVGILGKLFGF

SEQ ID NO: 42981 - protein, 44 aa, Staphylococcus haemolyticus; identical to SEQ ID NO: 42970
  strain JCSC1435

SEQ ID NO: 42982 - protein, 44 aa, Staphylococcus haemolyticus
  strain JCSC1435
MQKLAEAIAAAVQAGQDKDWGKMGTSIVGIVENGISVLGKIFGF

SEQ ID NO: 42983 - protein, 1123 aa, Staphylococcus haemolyticus
  strain JCSC1435
MNQHKKLQKFSIRKYAIGTVSTLVATFVFLGVNHDAQASEHLNPTQQHTNNNPENSINESSNTSIKPSDNKNTTGQVQSNQTSDTIREAKLIQQTNNKPQFNKDSSVSKQPSNTHVRKKRASNSDEIEFNRVVTGTVDNPSNAATTNSSLTPNDQQAPLIKPTFITSVGDAANTKRPIEILTSPNTDVALLDKDGATMGTGRTNETGHVTIIPQQWIPKGDVSAKATRGSESVTSDPVEALNTDPQHRPFVIEVTTDPFTRIELRDKYNKPLGASRTNDKGHAYIVPTRPIPEGNVTAVATDDSGNSSTSDPKKATDTTPPDKPIIHTNLVDKVGTLTPIEITTDPDTKVELFDKDNHLIGSGMTDHTGHITITPSKPLVEGTITAKATDDAETLNSSYSDPVNVTDLTPPILPNLETDLTGKAGTQTPITVTTDPNTTVELFDKDGNSLGKGTTDTDGHVTIIPNRPIPEGDVTAKATDNAEHPNSSTSQPKKATDTTPPIVPTFNTDIAGKAGTQTPITVTTDPNTTVELFDKDGNVIGSGITDGTGHAFITPTKPIPEGNVTVRATDDAEVPNSSTSDPVKATDTTPPNAPTFDTDISEKGGTLTPISVTTDPNTHVDIVDKDGNIIGSGTTDEQGHVTITPNVPIPEGNIFAKATDNAEHPNSTTSQPVNVIDTTPPMKPTVPRGLTGKANTQDPIEVITDPNTHIEIFDKDGQLIGTGDTDQNGHAFITPIKPIPEGNVTIKATDHAEHPNSSTSDPIEATDTTPPSVPKVNTGLNGKANTYTPVSVSTDPNTKVELLDKDFHVIGSGVTDEKGNAIITPTKPIPEGNVYVKATDNAARPNSSVSKPVKTTDTTPPPKPVVKGSMNGKAGTKDPIEIITEPYIKVEILDKDGHVIGSGKTDKNGHVIIKPNKPYPEGTIIIKATDNAQPPNSSFSDPIKVTDTTAPTEPKIHTTLIHKANTKTPVKVTTDPYTLVELLDKHGHVIGKATTDGNGNATIKPTTPIPEGEVTVRATDNAQHPNSSLSKPVKVTLADNDRAHKNGRRTNNTNQKDSKHNSGNTGDQGDNLSGYNQNDSNQNTVRSLPNTGYSNSESSTAFLMTSLLSGIALLSRKFKKEEK

SEQ ID NO: 42984 - protein, 4354 aa, Staphylococcus haemolyticus
  strain JCSC1435
MNYRDKLQKFSIRKYAVGTFSTLIATLVFLGTHTDQAHASENTNAAVEKAQQNTESQTSRDKNSNPNDAITIQNDQTSDQTVEINKQSKFVDKTSTEKKALETQTSEKEITNSTSTSIKEKIEESSPVTKEEKTNELKEKSSPIVGTQSSNQSKQKVKFSSSKSVKQIDDKIDTPRESKSDNRQKIDSKNISKLTNLTQEIQSKLLEVETIEPSNPNIEEAKKLTVESSSFTQSSNVSQQSLLDLVTRLEQTRNSLANVITRSQSGKRDPRNGQQIEKGTNFRFTTLNGRWNAGRNVIVYQRNYASLPDGRALGTGQQKNGVEGITSRKTVMRAYYKHEGNSKYLVYDVFFNNDGVNFISPGSQQRLGMALLLPYKVMKLNSDGSFASDSVRNLSYAAYEKRSGRNSLLSESPSDFIIDPDNSTQTIDMLRSNQHDFGHTTFYLSFGVRPGRSFNSDANEYFHSNRNNPDLRKAVEDQRGIFSGWNYGIGIQVDPNHPEGANRAYHMHLEVKLRDNVTTAELENAWSYANTAAMGGVSKSAYTVLSGRILPEDGALPSIENQPPVKPTINSDLVGKATTTTVIDVSTDPNTKVEIFDKNGNKIGTGTTDSSGHAYITPTRPIPEGNVTAKAYNHSDESKVSTSDPKFATDTIPPTTPVINTRLVYKAGTLTPIDVSTDPNTQVALIDKNGRIFGAGTTDSSGHVIITPDRVIPEGNVTAKATDNALHPNSSFSIPVQATTLIPVMKPVINTDVAGKAFSSPVIDITSTPNTRVELLDKNNNVIGRGITGSNGHVNITPDHYLFEGNITAKAYDQTDETNNATSDPRHVTDTTPPRKPVINTNLVNKVGTRTPIDVSTDVLTRVEIFDENGKSYGVVLTEMDGHGIITPREPLPLGKIYARATDGAETPNSIDSDHVPVTDTIPPTVPTVDTDLTGKATTLTPITVTTDPNTRVDLIDKNGHIIGTGTTDGNGHVIITPTTPIVEGNVIAKAYDPANNVSTSAPRKATDTTPPTKPRVTSPLGGKAGTTDPVTVTTDPNTNVQLLDKNGQIIGTGTTDSSGRVNITPTRPIPEGNVTAKAIDNAEHPNSSTSDPVKATDTTPPTKPRVTTPLGGKATTLTPVEVTTDPNTSVQLLDKDGRVIGSGTTGANGRVTITPTRPIPEGNVTAKATDNAEHPNSSTSDPVKATDTTPPTKPRVTTPLGGKATTLTPIEVTTDPNTSVQLLDKDGRVIGSGTTGANGRVTITPTRPIPEGNVTAKATDNAERPNSSTSDPVKATDTTPPTEPVVTNDLTGKATTKTPITVTTDPNTHVDLLDKDNHVIGSGTTDSNGRVTITPTVPIPEGNVRAKATDNAEHPNSSLSQPKKATDTTPPGSPIVNTDLTGKATTKTPVDVSSDPNTRIELLDKDNHVIGSGTTGANGHVIITPTQPIPEGNVTAKAYDNAEHPNVSTSEPKKATDTTPPTEPVVTNDLTGKATTKTPITVTTDPNTHVDLLDKDNHVIGSGTTDSNGRVTITPTVPIPEGNVRAKATDNAEHPNSSLSKPKKATDTTPPGSPIVNTDLTGKATTRTPVDVSSDPNTRIELLDKDNHVIGSGTTGANGHVIITPTQPIPEGNVTAKAYDNAEHPNVSTSEPKKATDTTPPTEPVVTNDLTGKATTKTPITVTTDPNTHVDLLDKDNHVIGSGTTDSNGRVTITPTVPIPEGNVRAKATDNAEHPNSSLSKPKKATDTTPPGSPIVNTDLTGKATTRTPVDVSSDPNTRIELLDKDNHVIGSGTTGANGHVIITPTQPIPEGNVTAKAYDNAEHPNVSTSEPKKATDTTPPTEPVVTNDLTGKATTKTPITVTTDPNTHVDLLDKDNHVIGSGTTDSNGRVTITPTVPIPEGNVRAKATDNAEHPNSSLSQPKKATDTTPPGSPIVNTDLTGKATTRTPVDVSSDPNTRIELLDKDNHVIGSGTTDSNGRVTITPTVPIPEGNVRAKATDNAEHPNSSLSQPKKATDTTPPGSPIVNTDLTGKATTKTPVDVSSDPNTRIELLDKDNHVIGTGTTGANGHVIITPTQPIPEGNVTAKAYDNAEHPNSSTSQPKKATDTTPPTEPVVTNDLTGKATTKTPITVTTDPNTHVDLLDKDNNVIGSGTTDSNGRVTITPTVPIPEGNVRAKATDNAEHPNSSLSQPKKATDTTPPGSPIVNTDLTGKATTKTPVDVSSDPNTRIELLDKDNHVIGSGTTGANGHVIITPTQPIPEGNVTAKAYDNAEHPNVSTSEPKKATDTTPPTAPVVTSDLTGKATTTDPVEVTTDPNTKVELLDKDGNVIGSGTTDNTGHVMITPTKPIPEGNVTAKAYDNAEHPNSSTSQPKKATDNAEHPNSSTSQPKKATDTTPPTAPLVTSDLTGEATTTDPVEVTTDPNTKVELLDKDGNVIGSGTTDNTGHVTITPTKPIPEGNVTAKATDNAEHPNSSTSQPKKATDTTPPTAPVVTSDLTGKATTTDPVEVTTDPNTKVELLDKDGNVIGSGTTDNTGHVMITPTKPIPEGNVTAKAYDNAEHPNSSTSQPKKATDTTPPTAPVVTSDLTGKATTTDPVEVTTDPNTKVELLDKDGNVIGSGTTDNTGHVTITPTKPIPEGNVSAKAYDNAEVPNVATSQPKKATDTTPPTTPTLDTDLDGKAGTQTPITVTTDPNTHVDLLDKDGNIIGSGTTDDTGHVTITPTKPIPEGNVTAKATDDAEHPNSSTSQPKKATDTTPPTAPVVTSDLTGKATTTDPVEVTTDPNTKVELLDKDGNVIGSGTTDDTGHVTITPTRPIPVGNVSAKAYDNAEVPNVATSQPKKATDTTPPTTPTLDTDLGGKAGTQTPITVTTDPNTHVDLLDKDGNIIGSGTTGDTGHVTITPTKPIPEGNVSAKATDNAEHPNSSTSQTKKATDLTPPVKPSVVGTLDGKAGTKDPVEVVTDPNTKVELLDKDGNVIGSGTTDSTGHATITSTVPIPEGNVTVKATDNAEHPNSSTSDPVKATDTTPPTVPTLDTDLGGKAGTQTPITVTTDPNTKVELLDKDSNIIGSSTTDDTGHVTITPTKPIPEGNVTAKATDNAEHPNSSTSQPKKATDLTPPVKPSVVGTLDGKAGTKDPVEVVTDPNTKVELLDKDGNVIGSGTTDSTGHATITPTVPIPEGNVTVKATDNAEHPNSSTSDPVKATDTTPPTVPTLDTDLGGKAGTQTPITVTTDPNTHVDLLDKDGNIIGSGTTDDTGHVTITPTKPIPEGNVTAKATDNAEHPNSSTSQPKKATDTTPPTAPVVTSDLTGKATTTDPVEVTTDPNTKVELLDKDGNVIGSGTTDSTGHATITPTVPIPEGNVTVKATDNAEHPNSSTSDPVKATDTTPPTVPTLDTDLGGKAGTQTPITVTTDPNTHVDLLDKDGNIIGSGTTDDTGHVTITPTKPIPEGNVTAKATDHAEHPNSSTSQPKKATDTTPPTAPVVTSDLTGKATTTDPVEVTTDPNTKVELLDKDGNVIGSGTTDDTGHVTITPTKPIPEGNVSAKAYDNAEVPNVATSQPKKATDTTPPTTPTLDTDLGGKAGTQTPITVTTDPNTHVDLLDKDGNIIGSGTTDSTGHATITPTVPIPEGNVTVKATDNAEHPNSSTSDPVKATDTTPPTVPTLDTDLGGKAGTQTPITVTTDPNTHVDLLDKDGNIIGSGTTDDTGHVTITPTKPIPEGNVTAKATDNAEHPNSSTSQPKKATDTTPPTAPVVTSDLTGKATTTDPVEVTTDPNTKVELLDKDGNVIGSGTTDDTGHVTITPTRPIPVGDVSAKAYDNAEVPNVATSQPKKATDTTPPTTPTLDTDLGGKAGTQTPITVTTDPNTHVDLLDKDGNIIGSGTTGDTGHVTITPTKPIPEGNVTAKATDNAEHPNSSTSQPKKATDTTPPTAPVVTSDLTGKATTTDPVEVTTDPNTKVELLDKDGNVIGSGTTDSNGHVTITPTRPIPVGDVSAKAYDNAEVPNVATSQPKKATDTTPPTTPTLDTDLGGKAGTQTPITVTTDPNTHVDLLDKDGNIIGSGTTDSNGHVTITPTKPIPEGNVSAKATDNAEHPNSSTSQPKKATDLTPPVKPSVVGTLDGKAGTKDPVEVVTDPNTKVELLDKDGNVIGSGTTDSTGHATITPTVPIPEGNVTVKATDNAEHPNSSTSDPVKATDTTPPTAPVVTSDLTGKATTTDPVEVTTDPNTHVDLLDKDGNIIGSGTTDSNGHVTITPTRPIPEGDVYAKAIDNAEHPNISISKPVKATKLIVKSHKKEAKNGHSKENENHNSRKSKNTIRDEKGNKINTSTKKKVKDLPSTGKKELTNNSLPYIVTLLGSFALLISRKRERKDNNRNK

SEQ ID NO: 42985 - protein, 291 aa, Staphylococcus haemolyticus
  strain JCSC1435
MNKVDAWLSKHDLKNLTTLIVVGAFILFLILLFMLMNHSDQGSNRITVSENAELRTGPNAAYPVIYQVEKGDTFTRLSKSGKWIEVESRDGSEKSWIAGWHTSLNIEAGANKKVNPLKNKVIVLDPGHGGNDQGASSNTSKKSLEKNYTLKTAKELRRALEKAGATVKLTRSDDTYVSLDDRKLNGDAYISIHNDSLDSPNANGATVYWYKNNQEALAETLNTNIQKKAMLFNRGTRQENFQVLRQTNKPAVLLELGYISNPTDEVMIRNQIHRQVVEEAVVDGLKQYFAS

SEQ ID NO: 42986 - protein, 2609 aa, Staphylococcus haemolyticus
  strain JCSC1435
MNLFKKQKFSIRKFSVGIFSTVIATLTFLSHPGHAATQEEESNSSQATSQNVKSQTDDKSIHNNDNYIENEKNSNDSIKEIATAIKINNSEINSKVDNANGTYRIDNEEIKENSIETNQDEKTIEPELSHQNISKNDSNNTFNENKSIHKRTKRSTDNNVDNNQDQMSINETNSGQIINGTFTDTSNGAVIPTNQTVSEMNQAGKITGWHVKDNDQTEIPLVWGPKALPPYNPYVFDKTNNKIAAVLSKYPNNLGGVAGDKTVGPIYQDVDVTPGSEVQLYFIGTSMGNTNGINGVKVSIYDSNNPTDLLYSGRPNTASKSFGVFTGVFNVPNNVSRLRFMFETFEKRSYESANGGRILKGKKNFGGSGLADVKVNSGAYLKATTTQTKYTVTSPSTSTSLINATLEVSLENKGHSRSNKTQYKVVLPEGVQFISAQNARANYNSSNRLLTLNVDRIEPGTIKNITYTVSLPTSEPIKKDFDATLVYVTDGINMNRRNGSRDFGSNADDNYFRYGGYNEYVKTESNQRRGNVTVATQSVTVEMYKTDLQQKYNQISAQIEHLNPSDYSQEAWSSMQNVLNASRQILNENDNTPINDRKNQATINDLTLRLDKERAKLDVDQAAKSRKEVINNNNDATREEKDTALTLLKATFDEKVRDIESATNINEISERKKQAIVDISPIDVIPAIKQQAIQSLNDKADEKLIEIENDTNATFEEREEAKTSVNEALTNAKNAVRNATTNQLVETVLTSNSNNISQISTHAIARDKARQELDRVIASKMSEIDNDHSATIEEKNETKAKIDEIAKQARLNIERGVHNDDVKVAKDKALNQLHNVQVDAIKKNQAKQIITDQANSKKAEIDQTPNATDEEKAAAKAKVDEAVTTAKNAIDQATNNDGVDTAKTNGVDTINNVQPTVVKKDEAKTAIDKAAEAKKAEIDQTPDATDEEKAAAKAKVDEAVNNAKASIDQATNNNGVDTAKSEGSDAINHVQPVVVKKDEAKTAIDKAAEAKKAEINQTPNATDEEKVAAKAKVDEAVTTAKNAIDQATNNAGVDTAKSNGLDSINNIQPTVVKKDEAKTAIDKAAEAKKAEIDQTPNATDEEKAAAKAKVDEAVTTAKNAIDQATNNNGVDTTKTNGVDAINNVQPTVVKKDEAKTAIDKAAEAKKAEIDQTPDATDEEKAAAKAKVDEAVNNAKASIDQVTNNEGVDTAKSNGLDSINNIQPTVVKKDEAKTAIDKAAEAKKAEIDQTPNATDEEKAAAKAKVDEAVTTAKNAIDQATNNAGVDTAKTNGVDTINNIQPVVVKKDEAKTAIDKAAEAKKAEIDQTPNATDEEKATAKAKVDEAVTTAKNAIDQATNNDGVDTAKSEGSDAINHVQPVVVKKDEAKTAIDKAAEAKKAEIDQTPNATDEEKIAAKAKVDEAVTTAKNAIDQATNNAGVDTAKTNGVDAINNVQPTVVKKDEAKTAIENAARAKKAEIDQTPNATDEEKATAKAKVDEAVTTAKNAIDQATNNNGVDTAKTNGVDAINNVQPTVVKKDEAKTAIENAARAKKAEIDQMPNATDEEKAAAKAKVDEAVNNAKVSIDQAINNNGVDTAKTNGVDSINNVQPTVVKKDEAKTAIDKAAEAKKAEIDQTPNATDEEKAAAKAKVDEAVTTAKNAIDQATNNAGVDTAKTNGVDSINNVQPTVVKKDEAKTAIENAARAKKAEIDQTPNATDEEKAVAKAKVDEAVTTAKNAIDQATNNNGVDTAKTNGVDAINNVQPTVVKKDEAKTAIDKAAEAKKAEIDQTPNATDEEKAAAKAKVDEAVNNAKASIDQATNNNGVDTAKSEGTDAINHVQPVVVKKDEAKVAINKAAEAKKAEIDQTPNATDEEKAAAKAKVDEAVTTAKNAIDQATNNAGVDTAKTNGVDSINNVQPTVVKKDEAKTAIENAARAKKAEIDQTPNATDEEKVAAKAKVDEAVNNAKASIDQVTNNEGVDTAKSNGLDSINNIQPTVVKKDEAKTAIDKAAEAKKTEIDQTPNATDEEKAAAKAKVDEAVTTAKNAIDQATNNAGVDTAKTNGVDSINNVQPTVVKKDEAKTAIENAARAKKAEIDQTPNATDEEKVAAKAKVDEAVNNAKASIDQATNNDGVDTAKSNGLDSINNIQPTVVKKDEAKTAIDKAAEAKKAEIDQTPNATDEEKAAAKAKVDEAVTTAKNAIDQATNNDGVDTAKSNGLDSINNIQPTVVKKDEAKAAIDKAAEAKKAEIDQILNATDEEKAAAKAKVDEAVTTAKNAIDQTTNNVGVDAAKESGVESINQVQPAVVKKDQAKAEIDNVAQAKKAEIDRNSNATEEEKVAAKSKVDEAATTIKQAIDKAVNNSEVDNAIDVGKTAINNIEADNSAKSKAIKHLQELVKQQMTKIDSNHLATEEEKAKAKQMIKLLFEKAKIEIEKAKTSYEVTKIDAEYSKLITKTLPENKAKLNAKKKIEKIARQLKNKLNNMNGVSKEEKDRIKVIIEQIVKKSFKDIDLASRNNTINKIVNDVKIQFANIKINKQNNKKSLINNENASVIITTEQHKTNKAYHKVRNEKGRYQLPNTGINNDTSSPLISFTFVSGLFLILRSMRRRASK

SEQ ID NO: 42987 - protein, 2156 aa, Staphylococcus haemolyticus
  strain JCSC1435
MNLFKKQKFSIRKFTVGTFSTVIATLSFITHTGHAAELDEQSQSAQQKVTETSGTDDTNQKSTAPDNASSQVESKEDTSYPSSKVETKADNNPAPKQNSVDDTSAKSSKSETLSNNKNSNKDLAETKSEANNVDTNQPSTEEKTLSNEKSIKAKHKRVKRDANDTSSNPQTQPDPMAINETNSGQIVNGNFTDTSNGAEIPTAATESAMDAASTIPGWQVVNSQQTQIPLVWGPKVLPSYTYVTFDKTNNKIGAVLSKYSDNLSYGRPDNNVGPIYQDIDVTPGSELQFHFIGTSMGNISGFNSARLFVYDANNPSTLLYKGTPKTSSQPFGIFKGVFNVPDNISRIRVQFESLVNVSHDTYSGHRLLKGPNNFGGGVVADVSVNTGAYLKVSPAQTEYQANSTSATSPNVNAKLNFSIENKGHSSSNKTQYKVVLPEGATFVTAENATGSFNEDTRELTLSINPIDAGTTRDVSYTVSLPTSVPIKKDFNANLIYQTEGINMNRKNGSRDLATQTPGDNNYLRYGGNNEFIIAESDQRQGTTNAPTQSVTVFMYKDAINNKISEIETELAQANQNDYSVEAWNNLQTALTNAKVVKNETDATPITDRKNQAEINNLLLNLEKAKAKFDVDKAAKARENVINSNTEATTEEKQVALTKLQNKYNEKKGEIDNLTSSSDIAPLKESSIAQINSINVRATKKAAAKQAIEAALTDRKVFIDSHYDATQEEKDVAMAKATEEANKAKALIDQATSNNDVDQAQTNGINIINSIDADVIKKANAKKAIEQAAEAKKALINQNSDATQEEKDAAIQRVTDEVRNADRLIDQSTNNDGVDEVQAHSISSINNIQPEIVKKSDAKQAIDTAVLNQKSLVNNNNEATQEEKDVALAKIDEAAKQAKAATDAATTNNAVDEATNNNTTIISGILPDTVKKAAARKAIDDAATAKKEAINNTSDATQEEKDAAIAKVDAAVTAAKQAITQATTNDNVDQEQNSGTSTITGIQPEVTKKAAARKAIDDEVVAKKAAIDTVADATDEEKQAAKDKVDAEATKAKAAIDQATTNNDVEQAKSSGVTTIEGIQPDTIKKSSAKQAIDDSANAKKAAIDNNSDATQEEKDVAKAKVDVEAAKAKTAIDQATTNDGVDQTRDLGNNSISVIQPDIVKKAAARKAIDDAATAKKQEIDQHPTATQEEKDAAKAKVDAEVQKAKDAITQANSNNDVDQVQNSETATIAGIQVDAVKKANAKQAIDDAAAKKNEIDQHPTATQEEKDAAKAKVDEEVAKAKRAIDSSTTNDAVDQAKDSGVTTINNIQPESIEKIKAKQAIDDTVTAKKNAIDQDGTTTQEEKDAAKAKVDEEATKAKQLIDQASTNDAVHETRDNEITAINKIQPEAIKKAESKQAIDDAATAKKAAIDQVSDATQEEKDAAKAKVDEEVTKAKSAIDKANTNNDVDQAKTNGTTIISSIEPEAIKKAEAKQAIDVAVSAKKQEIDNNENAIQEEKDAAKTKVDEEATKAKAAIDQASTNNGVDQAKTSGETTISSIQPEVVKKAEAKQAIDDAVTAKKAEIDQNQEATKEEKDAAKAKVDEEATKAKNNIDQSTTNNDVDQAKTDGASAITKIQPDVVKKSEAKRAIDDEVIAKKAEIDQNQEATKEEKDAAKAKVDEEATKAKQSIDNATTNEAVDQAKTQGVTTITAIQPDTIKKAEAKRAIDEVAKAKKQEIDNNTNATKEEKDVAKSKVDEEVTKAKSAIDQATTNDQVDQGNNNGHTAIAPIQPETIKKPEAKQAIDEVAKAKKDLIDQTPNATKEEKDAAKSKVDEEVTKEKKEIDQASTNSDVDQVKDKGTNGINSVVVEVVKKDAAKKAIDELVKAKKSEIDNNHNATREEKDSAKSKVDEEAKKAKDNIDKGATNNDVDQAKNSSSNIIKKIQPDTTKKTVVKQTLLDQAKAKKAEIDKDNKATKEEKDAAKAEVDKIIDKANKAIDNANSNDDVDKVQVTFTSKLKEVKVKIVKKPKAQETILNVARKQKAKIDALVGLTDEQKNKAKNMIDEIVKNALEKLDNDINNNDVDSITNKAIEEIEKVNPEVSKGKKALASGNNNDGYRNNNSSDNYNTSSGNNKDSIKLPSTGKEGQNQSPLAGLALISGLFLFLKNRKRNKENS

SEQ ID NO: 42988 - protein, 205 aa, Staphylococcus haemolyticus
  strain JCSC1435
MEEKFNNEQEERQFRQFQEYQKQQEEEKKKKRKKSWLFGCGGCLVLLILIIIGVTACTGSFVNEVDKEINEEGKLDKDKDTKIKSVGETTEIDGVSFTLDSASYTDERNEFAEVQADKVLKVDMTIKNNSKEEIPVGGDVKVYVDGKQAKSYPITDGLMDSLSPNREISGSEGFAINGNPEKIELEFQPLTSFSNKRYIYDVKPE

SEQ ID NO: 42989 - protein, 235 aa, Staphylococcus haemolyticus
  strain JCSC1435
MKKTIIASSLAVGLGVVAGNAGHADASEAQVNKAELAQLAQSNDQSLNDSPIQEGAYNVTFDYEGFTYHFESDGTNWSWNYAQSGQASQQQDVSAQASTVSNQTSAEQVGSQQQSSQAQPTQTQQAPQTEQTQQPQTEATTSNSSSSNNNASSGSSVNVNSHLQQIAQRESGGDITAINPSSGAAGKYQFLQSTWDSVAPDEYKGVSPAQAPEDVQDAAAVKLYNTAGASQWVTA

SEQ ID NO: 42990 - protein, 238 aa, Staphylococcus haemolyticus
  strain JCSC1435
MKKTVIASSLAVALGVTGYALTTDNSAHASESTTNYAQLANLAQNNPSELNAHPVQAGAYNITFVKDGFKYNFTSDGQSWSWNYTYVGGADTVATTQAAPAAQSTDYSASYSNEASTQSVSSNQQSSNTNVEAVSAPKTTSYSASTSSSSSASTGGSVKEQFLANGGTEAAWNAIVMPESGGNPNAVNPAGYRGLGQTKESWGTGSVASQTKGMINYANSRYGSLDAAIAFRDNHGWW

SEQ ID NO: 42991 - protein, 54 aa, Staphylococcus haemolyticus
  strain JCSC1435
MIFVMLSPLLIIGFIALSIMEERKRKKKTEQKEAEFEKEKNKVSNPEYDDDHKA

SEQ ID NO: 42992 - protein, 263 aa, Staphylococcus haemolyticus
  strain JCSC1435
MDAHGVDIKVVKAEFVDNYDEYSAPVNGKALRVYINFRNNNDDQVLMDNTDFSMKVNNENYEEWYGSEDMHEGFSHQLNQHNTASGYITYDVPDSDHYTLELDTIPNFNKVRAQWIINKSEIKNSNVTKDTLTSSTTDVEDESDTTSSSKKNDDSNQADVGVTYPAYMYNALVDEYNSLTDGEKMNHVSKDVLEIEYDQLEACVEALYEKENAKAKKNTKKQCKIMKTNWLKKNMNNNKQNKLKMKHLNLMTIQMVLVLMILH

SEQ ID NO: 42993 - protein, 3608 aa, Staphylococcus haemolyticus
  strain JCSC1435
MSRKERNFKRFFGQEKARVKLYKSGKQWVKAGIREVQLLKVLGLPFLNKDVEQINNLDTNKDKNFKNQAMKATGLAGGAFTFAMLNDHHAYAASETPMTSEIASNSETVANQNSTTVTKSETSTTEYISSQTSTSQDATSSTNSTEKSTSSSTTDSQTSTDSTSDKSTSNSEKQDSSMSNSDTKASSSSTTDNSTSNNSTTSEKDTNSQANTTSTDSQKGSTSTNDNSITSTSTKDNQIRKNSTESNSITASNSTSDSNSGSTVSTNSTTSQLTSTSESQINTDLGSTLLVSDSTSTSTSTAPLKLRTFSRLATTTFAAAAATSTTNTYTGAGTDTNYNIPIYYKLTTVNNGTSMTFTYTVTYDNPATTTVERPTALSNSYAIYNTGTTNQTMFTLGSAYGTPSTATSYITDSTGAQVSNPRANTTNINKQGSGYTWANGYQMNGAQAKQGYGLTTTWTVPINSSGDTSFTFNPYSTSVTGGTNFFNGKKVTVTDPTSTANSQSASTSTANSQSASTSKSTSTANSQSASTSTSTSTANSQSASTSTSTSTANSQSASTSTSTSTANSQSASTSTSTSTANSQSTSTSTSTSTANSQSTSTSTSTSVSDSTSASTSLSGSTSTSVSDSTSASTSLSDSASTSVSDSTSASTSLSASTSTSESDSTSASTSLSESTSTSLSDSLSASTSLSDSASTSVSDSTSASTSLSGSESASLSDSASASTSLSESTSTSESTSTSESDSTSASTSLSGSESASLSDSASASTSLSGSESASLSDSASASTSLSGSESASLSDSASASTSLSGSESASLSDSASASTSLSGSESASLSDSASASTSLSESTSTSLSDSASASTSLSESTSTSVSDSTSASTSLSASTSTSVSDSTSTSTSDSASTSTSVSDSTSTSTSLSGSTSTSVSDSTSASTSLSASTSTSVSDSTSTSTSDSASTSTSVSDSTSTSTSLSGSTSTSVSDSTSASTSLSESTSTSLSDSASASTSLSESTSTSVSDSTSTSTSDSASTSTSVSDSTSTSTSLSGSTSTSVSDSTSASTSDSASTSTSVSDSTSASTSDSASTSTSVSDSTSTSTSLSGSTSTSVSDSTSASTSLSESTSTSVSDSTSASTSLSDSASTSVSDSTSASTSLSESTSTSVSDSTSTSTSLSESTSTSVSDSASASTSLSDSASTSVSDSTSASTSLSGSTSTSVSDSTSTSTSLSESTSTSLSDSASASTSLSDSASTSVSDSTSASTSLSGSTSTSVSDSTSTSTSLSESTSTSLSDSASASTSLSASTSTSVSDSTSASTSLSGSTSTSESDSTSMSTSLSGSESTSLSDSLSASTSLSGSTSTSVSDSTSASTSLSGSTSTSVSDSTSVSTSLSASTSTSESDSTSTSTSDSASTSTSVSDSTSASTSLSASTSTSVSDSTSASTSLSASTSTSVSDSTSASTSLSASTSTSVSDSTSASTSLSASTSTSVSDSTSMSTSLSGSESTSLSDSLSASTSVSASTSTSVSDSTSASTSLSGSTSTSVSDSTSTSTSLSESTSTSVSDSASASTSLSASTSTSVSDSTSASTSLSASTSTSVSDSTSASTSLSASTSTSVSDSTSASTSLSASTSTSVSDSTSTSTSLSASTSTSVSDSTSASTSLSGSASASLSDSLSASTSVSASTSTSVSDSTSMSTSLSGSESTSLSDSLSASTSVSASTSTSVSDSTSASTSLSGSTSTSVSDSTSTSTSLSESTSTSVSDSASASTSLSDSASTSVSDSTSASTSLSGSTSTSVSDSTSTSTSLSESTSTSLSDSASASTSLSDSASTSVSDSTSASTSLSGSTSTSVSDSTSTSTSLSESTSTSLSDSTSISTSLSASTSTSESDSTSTSTSLSGSTSTSVSDSISRSTSLSGSTSTSVSDSTSTSTSDSASTSTSVSDSTSASTSLSASTSTSVSDSTSASTSLSASTSTSVSDSTSASTSLSASTSTSVSDSTSASTSLSASTSTSVSDSTSASTSLSASTSTSVSDSTSASTSLSASTSTSVSDSTSTSTSLSASTSTSVSDSTSASTSLSGSASASLSDSLSASTSVSASTSTSVSDSTSTSTSLSESTSTSLSNSASASTSLSGSTSTSVSDSTSASTSLSASTSTSVSDSTSMSTSLSGSESTSLSDSLSASTSVSASTSTSVSDSTSASTSLSGSTSTSVSDSTSTSTSLSESTSTSVSDSASASTSLSDSASTSVSDSTSASTSLSGSTSTSVSDSTSTSTSLSESTSTSLSDSASASTSLSDSASTSVSDSTSASTSLSGSTSTSVSDSTSASTSLSGSTSTSVSDSTSTSTSLSASTSTSESDSTSTSTSLSGSTSTSVSDSISGSTSLSGSTSTSVSDSTSTSTSDSASTSTSVSDSTSASTSLSASTSTSVSDSTSASTSLSASTSTSVSDSTSASTSLSGSASASLSDSLSASTSVSASTSTSVSDSTSTSTSLSESTSTSLSNSASASTSLSGSTSTSVSDSTSASTSLSASTSTSVSDSTSTSTSLSESTSTSLSDSASASTSLSDSASTSVSDSTSASTSLSGSESTSLSDSASASTSLSASTSTSVSDSTSTSTSDSVSTSTSMSDSTSMSTSLSGSTSTSVSDSTSASTSLSGSTSTSVSDSTSVSTSLSASTSTSESDSTSTSTSLSGSTSTSVSDSTSASTSLSGSTSTSVSDSTSTSTSDSASTSTSVSDSTSASTSLSASTSTSVSDSTSASTSLSASTSTSVSDSTSASTSLSASTSTSVSDSTSASTSLSASTSTSVSDSTSTNTSLSASTSTSVSDSTSASTSLSASTSTSVSDSTSASTSLSASTSTSVSDSTSTSTSLSASTSTSVSDSTSASTSLSGSASASLSDSLSASTSVSASTSTSVSDSTSTSTSLSESTSTSLSNSASASTSLSGSASASLSDSLSASTSVSASTSTSVSDSTSTSTSLSESTSTSLSDSASASTSLSDSASTSVSDSTSASTSLSESTSTSVSDSTSTSTSLSGSESTSLSDSASASTSLSASTSTSVSDSTSTSTSDSVSTSTSMSDSTSMSTSLSGSTSTSVSDSTSASTSLSGSTSTSVSDSTSVSTSLSASTSTSESDSTSTSTSLSGSTSTSVSDSISGSTSLSGSTSTSVSDSTSTSTSDSASTSTSVSDSTSASTSLSASTSTSVSDSTSASTSLSASTSTSVSDSTSASTSLSASTSTSVSDSTSASTSLSASTSTSVSDSTSTSTSLSASTSTSVSDSTSGSTSLSASTSTSVSDSTSTSTSLSASTSTSVSDSTSMSTSLSGSTSTSVSDSTSASTSLSGSTSTSVSDSTSTSTSLSASTSTSVSDSTSTSTSLSGSTSTSVSDSTSASTSSSESTSTSVSDSTSASVSTSISTSISMSESSSTSASTSDSTSTSASTSESRSASHSMSGTDSNNTSSSDSKSHSISNSDSNTTSDSASASTSISDSSSTSTSDSNASHSFSTSHSVSESNSMSTSHSQFDSISTSESMSGTDSTSLSTSLSHSASTSNSTSMTTSESQSNNDSQMHSNSLHHDAKDELPDTGDSDSNSTGLVSAVAAMLAGLGLFGKSRKNKKDKKNKGSEQ

SEQ ID NO: 42994 - protein, 1067 aa, Staphylococcus haemolyticus
  strain JCSC1435
MDKKQLGNKREAYSIRKYSIGAASILVGSLLFLGGGQASAAESNETNTSEKVSTEQAQSTQEQPSHETSTHSVEQPQNKAIATQETKTNEDASSEETQSNEADTESNEVIHNDTQSNETSEQSTEEPKTQQNKASDDVTTQEVTSTEQPTQEKTQSTSKQEVTTQETSTTEVQPKNGQSQTEEQPQHETKETSSQSNTQEAPTKETKKPTQPTTENKQSEKSNTTQQTNQKANSEVSQSNVTSTEEVTNTNETRTRTQPFSKEEMNKVTATEESDVAVSDVPQTQMKYMSTKQKQVLFNTLQRDANTQDQQPKAILSTIPEWTSAQRTKNASRTGQDQLNITHKGRYTSGADFGNGGTEIVKYNPKNGYAYSVNGDKEALDIIDVKHPGKDGAINLVKRIYLQDNGIEAGDLTSVTVHPSGDYVAVSAPAVDKTKPGHVVFYGSNGDYINNVTVGSLPDMITFSKDSKYLLVANEEEPSDDYTVNPPGSVSVIDVTGGPANVTANNVRTAMFTKEHQEGIRALGPNAEDAYLNIEPEYIAVDSQSKYAYVILQEVSAIAKVDIVKGQIVQVKGLPYKDHSLAQNAMDVSDEDGKSELRRAPVLGLLQPDGIDTYDYNGETYLLIANEGDSQDYEGYSEEKRVKKLKDDIQLDARYYQGYTQAELDDMVKNGLFDDEQLGRLKVTTSHAFKDADGKYNALVSYGGRSFSILRASDLEMIYDSGSDIEQRVLDLLPERFNANYESADDIKVDDRSDDKGPEAENVVVGKVGSHSYAFVGLERVGGIMIYDITNPNEPYFVKYLYDPDNKDISPEGITFESAEESPNGKPMLIASFELSGTTSAWELEDLTGDQESDDGEDSDNPGNTNGESNDDDTTPNPPSENDGSNTDHDVDNGEQPDNGDDTSNNDEDNHSSDDTNGNDEGLEPPYEVDGDIFEDDSDEVISDKEDNNDTSAQSHEKVENKGTSHNMNQGAHANHQEESRDKQTINSNTHNLSVVSTKSSSHHVGATNYGSVVSEETNHLNTSNNKETSELPKSGQTETNTTLWSVLLGGLGLAFIRKRKASKSEK

SEQ ID NO: 42995 - protein, 748 aa, Staphylococcus haemolyticus
  strain JCSC1435
MKTRENRFSIRKLSVGASSVVVATLLFMGGSSAQAAEKQQEVGTPETASAQSIGDKDTHATQKGQVQSTEQDKSQASQTENNTNNSQTSLHNEHNQTDDASTTNETTSTSDETHQSTTVKSEKPTSNSDNQQNEAKQTSQQSLSTDTQTSKPTTNDGITTQQSESSKQEKPSTQSTDTASKEDDTTKKTTAHTQSQTDETSDNKKEALNQPHSNVVKSEDANTSSNEINPNTIKSTEQQQSTESNTSDKPKVDNQQAQSQPKDNDDNQGDALKTATQAQQQTLTKKEATTSEVTNRLNTQNSDNNISIDGQTNPTLDSDKSSKQNKDAQSGLNTLKNNAVATTNTQSKSQAATGTKDQTNKVAKQAQYKNQDPIILVHGFNGFTDDINPSVLAHYWGGDKLNIRQDLEENGYESYEASISAFGSNYDRAVELYYYIKGGTVDYGAAHAAKYGHERYGKTYEGVYKDWQPGQKVHLVGHSMGGQTIRQLEALLRNGNPEEQEYQHVHGGDISPLYQGQNDNMISSITTLGTPHNGTHASDLLGNEALIRQVVFDAGKVLGNKDSRVDFGLSQWGLKQQPNESYVDYVKRVKDSKLWQTKDNGFYDLTREGATNLNRQTSLNPNIVYKTYTGESTHASLFGRQKSDLILFFPFTLTANVIGKAAEKEWRENDGLVSVISSQHPFNQAYTQATDTNQKGIWQVTPTKHDWDHVDFVGQDSSDTKRTRAELQQFWHDLADDLVQSENLTRNA

SEQ ID NO: 42996 - protein, 1563 aa, Staphylococcus haemolyticus
  strain JCSC1435
MNKNSKKKLDFLPNKLNKYSIRRFTVGTASILVGATLIFGVANDQAEAAENNTTQKQDDSSDASKVKGNVQTIEQSSANSNESDIPEQVDVTKDTTEQASTEEKANTTEQASTEEKADTTEQASTEEKADTTEQASTEEKADTTEQASTEEKADTTEQASTEEKANTTEQASTEEKADTTEQASTEEKADTTEQASTEEKADTTEQASTEEKANTTEQASTEEKADTTEQASTEEKADTTEQASTEEKADTTEQASTEEKANTTEQASTEEKADTTEQASTEEKANTTEQASTEEKADTTEQASTEEKADTTEQASTEEKANTTEQASTEEKADTTEQASTEEKADTTEQASTEEKANTTEPLTDNQDESTEDESIEAKKALLTEYVTSNSDVSEEEAKAEIQDIDLQDVDFSNANENTLLSTLVKNISNKKEEDEKLATPRAISRIASPVMLAATDNVAAQESGTNVNNKIDVTSLQTDKNTVRPNDGEGFSVTSTFKVNGKVNEGDYFTVDMPDYANFNGIADYTAVDNKIYPTIKDGEQVVANGVYDVDTKKLKYTFTDYVNNKQNIEGGFKLPQYIDRKTATQSGDYNLNYNVAGNEVNIPISVQYDNYRDGHVIANATSLITNADIFNTGSHEYTQYIYVNPQSVNSYDTWLTIQGYQNQVNDSSAIFNSNDTSIEIFDAESSSNINPSFYVNDSNYRNVTSNYQINETGDKQAKIYFGHIDHPYIVKVTSKIDPNSTADLKTRIRMDNKNYRGTTDYYIHDNTVERSGANGIAQGDEALYNLGDYVWEDTNKNGIQDSDEQGIEGVTVTLTRPNGTTETTTTDSNGKYQFSDLQNGSYVINFQTPEGYTPTKSYQGMNTEVDSNGLSTVGIINDADNWTLDSGFYKTPVKYSLGDYVWYDSNQDGIQDYEERGIEGVTVTLTHPDGTVETTTTDSNGKYQFDNLDNGDYTVHFEKPTGLTQTVVDSGNDDAKDADGETVKVTIKDHDDFTIDNGYFESTSDSESQSDSESTSDSESTSDSESQSDSESTSDSESQSDSESTSDSESTSDSESQSDSESTSDSESTSDSESTSDSESTSDSESQSDSESTSDSESQSDSESTSDSESQSDSESTSDSESTSDSESQSDSESTSDSESTSDSESQSDSESTSDSESTSDSESQSDSESTSDSESQSDSESQSDSESQSDSESTSDSESTSDSESQSDSESTSDSESTSDSESTSDSESQSDSESTSDSESQSDSESQSDSESTSDSESTSDSESQSDSESQSDSESTSDSESQSDSESTSDSESTSDSESQSDSESQSDSESQSDSESTSDSESTSDSESQSDSESTSDSESTSDSESQSDSESTSDSESQSDSESTSDSESQSDSESTSDSESQSDSESTSDSESTSDSESQSDSESTSDSESQSDSESTSDSESQSDSESTSDSESQSDSESTSDSESTSDSESQSDSESTSDSESQSDSESTSDSESTSDSESQSDSESTSDSESTSDSESQSDSESTSDSESHSDSHLPDTGEEESNKSGLIGAGLAALGGLSIFGRRRKKNSEQ

SEQ ID NO: 42997 - protein, 57 aa, Staphylococcus hominis
MENSKIMKDIEVANLLEEVQEDELNEVLGAKKKSGVIPTVSHDCHMNTFQFMFTCCS

SEQ ID NO: 42998 - protein, 754 aa, Staphylococcus hominis
MKKSENRYSIRKFSVGASSILVATLLFMGGGAAQAAETHQEVGNPESAVAQSIGDHKKQSDNPETQQDNVQSDEQATSTSQSVTNENEAQRLHNENKASTQVKDSTDQLNTNEGTTDNIVTHQSTKHSVAETEEASTTKTSSDDPESVSTKEEQPSLETQESTKNTIQKDTLASDKKDNTTGNLKIPKDKQFIQKANESPTEEKTTTQTTTAETNTSSTKDNTSKTTDSHSTKTSQSTPLTESKELTPSKTQQDSNVNQDAIKNNDVEAPSTGKTNDTVDTTETKQTVTAKQPTDPAAPTVNTLNTKDEAISIDGTTNETVGHKDAKDQKNSQAGLETLANNAVATTNNASQQQGTTETKDQTNKVAKQGQYKNQDPIILVHGFNGFTDDINPNVLSHYWGGDKLNIRQELEQNGYNAYEASISAFGSNYDRAVELYYYIKGGTVDYGAAHAERYGHERYGKTYEGVYKDWQPGQKVHLVGHSMGGQTVRQLEELLRNGSQEEIEYQKTHGGDISPLLQGGHDNMVSSITTLGTPHNGTHAADELGNEALVRQVVFDLGKRLGNKNSRVDFGLSQWGLKQQPGESYISYLLRVKNSKLWQSKDNGFYDLTRDGATDLNRKTSLNPNIVYKTYTAEATHPTLTGKQKADYNMFLPFTVTGNVIGKATEKEWRENDGLVSVISSQHPFNQAYTEATDTNQKGIWQVTPTKHDWDHVDFVGQDSTDTKRSREELQQFWYDLADDLVQTEALTSTNEA

SEQ ID NO: 42999 - protein, 63 aa, Staphylococcus hominis SK119
DSDADADSDKNHNDKVDKSNSKELPNTGNNDQNNGTFYGSLFAALGGLFLVGRRRKNKGNEEK

SEQ ID NO: 43000 - protein, 434 aa, Staphylococcus hominis SK119
MPIITDVYAREVLDSRGNPTVEVEVLTESGAFGRALVPSGASTGEHEAVELRDGDKSRYSGKGVTKAVENVNEIIAPEIVEGEFSVLDQVSIDKMMIQLDGTPNKGKLGANAILGVSIAVARAAADLLGQPLYKYFGGFNGKQLPVPMMNIVNGGSHSDAPIAFQEFMILPTGAESFKEALRWGAEIFHNLKSILSERGLETAVGDEGGFAPRFDGTEDAVETIIKAIEKAGYKPGEDVFLGFDCASSEFYENGVYDYTKFEGEHGAKRSAAEQVDYLEELISKYPIITIEDGMDENDWDGWKQLTDRIGDKVQLVGDDLFVTNTEILSRGIEQGIGNSILIKVNQIGTLTETFDAIEMAQKAGYTAVVSHRSGETEDTTIADIAVATNAGQIKTGSLSRTDRIAKYNQLLRIEDELFETAKFDGIKSFYNLDK

SEQ ID NO: 43001 - protein, 2732 aa, Staphylococcus hominis SK119
MNYRGKLQKFSICKYTVGAFSTVIATLIFLGSPQAHASEQLQKDGQVIQAKARDQEQTSNETSNKQVQSNTEPKASPVSESQKGNNETLNKVQTTDTLTNDLTSFSSQNENKDTSHTTTDLKENNEAKSQLNKLDDINVTEVNEGHNHDNRNRTRYEDREASDDTLVSSTSTTIDGDKLQAAYDRSYAEYQKIDREQSDNKKVAQIKATFNKVNHFFSENNNSNQTLINELYKELEQANALIESLPQRQVRTISTRANREARAVRSSRRPVRGQGGTRPPSNTANTYTPPVVHNSRPKPGSKVKKNSDLYNNAKKEWYVENENDGSGYWSGTFLHATNKSAPYYATRSHYRNMSPSSVRGIAEISSIRQNDGYLWTINFNKYHIKRNGMVFWFGLPKGQTPTGPVRFTTTDVNGHETSSSGTGDGRDQALSRMWDSAGGITSSAYNFRQGNPLNRSEFYNDSVNHIYNLGDFARGNENQPFTFFEREGVPNKIKVAGDDIYRYLTAQVDHNQGIDHIYAFQARGTDSYTIQFKTSGSSQDRLYYAAGGRGIEFNEINNYNQLYLEPLEQYNDRKTKIVDVIDRVLHIDHVESAYDVPERRIMKKHYLDGDFATHEYAEDVASYLSNPSDHVMGLFPRVPTDRYRGNFGVNPLNSYEIHEMFSEEKLKEAARTGRPIEIFVGFNVSDAYHNGETIKKVNLFVKPKLEQSIGFYSDNATDNKENSPESQAAHHAVFLQQEGQMLNTVTNGNNKDYHQNIRIQFKSNESANVWEISGYPPSLQIEDAVDRPNTELEKNKVLVGQLPPGRHVMTARIGNETKIFEVIAKPNPPVISTLAAQLGQKGGKKPTITVTHVPQDERAKVRLVSGGIDGAGPGTAPSGYTVLAEKMANLDGTVTFEESDYTNPLPNNGVIRAITYYEDSVQSNFSNSINVGLDTTPPTFSNVRGLQDKYYRGDNVNISIPVSDNAYGSGVEDASITGNSGLQAVFNRDASGDAGTLVITGTISNDVTWNSDILVQPVAHDRAGNTTNVSPYHLHIGKLSDDKPVQLFSQQELKTVVNPNSISQSERNDIINSLKAKNSSLTSFLSTFNPYMVDNDGRVVLTFKDGSTRIIDPAQVITYRPQRKSIYTEPGSSNTKEAFITIAKGQEYTIGPDLRKYFSLSNGQDIPNNSFTTINGSSIPSPQAISRLNAGIYTYNVDALNAYNHSSERLTIKVNVVDVNTLAENQRVYRSTTKNLSNDEITQVRNAFKDANPQLNLNDSDIRIENDEPLSNHPSRVRVTITKGELTKQFISTFDHMDFLKWINLRNDYTVTWTSQKLNGRGTDGGFEWSPDGKTIIYRYDATTGRRITGNDVLSLLRATPKHAGLRNHIEGQEKILAESGSARGFKPVGYSKGNSIYSDGEHPFTYDGQPIQVLDIVDSNTGYSNSVIARSDYRHTSSNSTVMSGDIPAMNGAAGFHLDKVLKQNGTGNGIMGAVDKQQLYLTPYGAKSYIERLGQSMSSTDNVINIVFVPTDKVTPNIVLDNYNDHVVFSGETFRNTLTLTDNFGIKNVTVPNDSQIPMNVLNHSILSGVAPNVSTPMSKQVKVKVTDGSDNETTAVFNVLIKPLKDKYSVMTTADESHPIRIANISNNASLSETDRQAIFNSLDISKSITNRNYVTDGSNEIRSREISNVHRSGNNANVEVTITYADNSRTSITVPVKHVIPNIRGIELFTVQGQPFPSGKGTNNNDFFVINNDHPLTDATVTWIGNGPDINSTTVGVPQILRANILFDGETTPIEKEAHYRVVKAKPKRVYQTTINGNFLSSNEGLSSNVGSFVEGIANYLPSGTNFDWAPGSGQPLSNSPGIFTETINVIYPNGQVDPVNVLFKVKPTTPSIDTLSTKYKADLSGQSIKVNNVPNNAQVKLYTEDGREMSNTTMTRNRDGSVSITIPGVLPLGNIKAKSIITVDHVTITEQNNSGSVVNSTRSESIESDLSASSPVTKQLEAVDGGLKFVKGDNIDLNNPRTYINSNSDIIRVEWEQNANQWKNTIGTTTKRAIVTLSNGETRTVSIPVTIYAPATAKAPQRDVVGHALTYGDDAANYVTFENNYMNGATVTWKNNNAPNNNIAGVQSLTAEVRYNGINHVYNVPVKVYEYKYKFKKSEYSTIVGTSFEGNGNINNYVVLENANGLPTDGFHFVWTQNTTASHSEQWSNLAHPNQAFKKEARFEVLDNQNHVFFTSDPAIFKVTNAVPNPATVTQNDVGDVVISPGVGKNLGVNAGNIIVNPDRITVKKGNQVIGTFIKNNTGKWTKASDSINTPGLSVSPDGNEIIYDKMSVPNDTLINTESTTGNGELTSEAAISATYKVKPATPSNTTFAFKQNGEFEVIPNNANASTTKNPTDKVKISYVEKIGNSTEQSRELIVTKNNQNQWSMNNQLDYVTLDSRTGKVTFKANSLKPHVLINTESIAGSDDNFSHNTVGIVGPEHHDVIIHEIVKEPGERVSNEELNNAINVDNKDHANVNEGVSLPTNLQSDTTQTVPTRITYRDGSIEIVNVPIRTHADKSSIRNALPKLDAQGDTNGKTPSSVSAYNNEMQHLHDEIEAVRRRANEVLSNDRATNTDVANVTNNINDVSLKIQHAISLLQNKADNSALVEAKRQLDEATAEQDPTPGMTQVTSDNYRAKKAEAERISSEAQGVINNGDATAEEIRNEKAKVEEALTQLTEAKNALKADKSVLEQKRPGLNHVGVTEG

SEQ ID NO: 43002 - protein, 248 aa, Staphylococcus hominis SK119
MKKTIIASSLAVGLGLVAGNVSHADASENQINKEKLAQLAESNDQSLNQHPIQEGAYNYQFNLNGKTYHFWSDGTYFKWEYYPSNGSTVNSANQNVASTQTAQNVSYQNNNYKNINQSASTSNVSQHYANEAQTQQAPKTTQTKQATQTQQAPANATTNQPKQSTSGSSVNVNSHLQQIAQRESGGDIHAINPSSGAAGKYQFLQSTWDSVAPAQYKGVSPAQAPESVQDAAAVKLYNTAGPSQWVTA

SEQ ID NO: 43003 - protein, 65 aa, Staphylococcus hominis SK119
DSDADADSDADKAHNDKADKSNSNELPDTGNNNQNNGTLFGSLFAALGGLFLVGRRRKNENNDEK

SEQ ID NO: 43004 - protein, 291 aa, Staphylococcus hominis SK119
MNKLDTWLTKHDLKNMLTLVVVLLFILFIILLFMFMNHNDQDSNRLTITEDAEIRTGPNAGYPVIYKVEKGDSFKKLKTTGKWIEVQNAKGDKKGWVAGWHTSLNIKADVNKQENPFKNKTVVLDPGHGGSDQGASSSTALKSLEKNYTLKTALELKRALEKAGAHVKLTRTDDSYVSLDNRKATGDVFISIHNDSLDSHNANGATVYWYQNSQETLAEILNANIQKKSLLSNRGVRQQNYQVLRQTNKPAVLLELGYISNPTDEKMIRNQLHRQVVEEAVVDGLKQYFAS

SEQ ID NO: 43005 - protein, 88 aa, Staphylococcus hominis SK119
MSKRRQGPINKRLDFISNKLNKYSIRKFTVGTASILVGATLIFGHADNEAKAAEENHMENTSLNSIENDNDKNNQKIDSSNETATTST

SEQ ID NO: 43006 - protein, 212 aa, Staphylococcus hominis SK119
MKKVSFVASTLLTSTMLLTTTQSVEAHTTNLVTKENAKQIATDALSNSGGNPNLQRLGRTVDKGDYFEIISHNRLNEGNGMYKVHKNGEVEYKNGRYSDFNQLQDTRIHAESGIAKAAKTTSSNHKQVNSVDCARELNRYYVGTVASSEVPSSKSLKDTQTSQSSVKTLPSTGDDTQQHSIQLLASLLLVMGTSLLLKRKHHSHSYLSTEHF

SEQ ID NO: 43007 - protein, 70 aa, Staphylococcus hominis SK119
MSKRKQGPINKKVDFLSNKLNKYSIRKFTVGTASILVGATLIFGSGQEEAKAAESDQTVTNQDNTSSPTD

SEQ ID NO: 43008 - protein, 1326 aa, Staphylococcus hominis SK119
MNLFKKQKFSIRKFSVGTFSTLIATLVFLSHPGHAATHDAETNTSAPQTNESATINKQNTNIEQPHNETTSANTSNSNENNRNNESNTSSDYSINREREEGTVNNVINSTENNTNHNEKVTTNDVVSNENNRETTNVNQPHRRGKRSVDNTPSTTNTDPMVVNEQNTGQIINGTFTDNSQGATIPTKNLESAMNEANTVPGWHVNSNDQTIIPLIWGPKSLPAYNPYIFDKTNNKIGVVLSKYNGNFNQVPGIADPTVGSIYQDVDVTPGSEIQLHYISSSMNNIWGVNGARVYIYDANNPSTLLYKGTPDILQNPIGNFVGVFQVPETVSRLRLRFESALNRSTDSTNGHRLLTGPNNFGGGVLADVTINSGAYLTATVNNTHYFAQSGSINADRVYQEIEFRIENRGHSSSNKTEYTIVLPEDVTYVSTKNATGKFNAATKELTVKIDRLEAGASKNISIGLSLPTDRPIEKEFLGHLTYVTDGINMNRLSDSKDFGRNNGDHYTRYGVHNEFVSVDSAMRQGDIVLDKQTITVKMYKQHLRDKVTEIEDDLANLDQNDNSPEVWEAMQVVLRKAKEVLAETDEMPISELKDQATINSIDLNLDKAHAKLSLDKVARTKRALFMGNDTATIEEKNAVIERVNQALHSSYTTVDQSMTSNDVATNKDTGINEITMIDLTPTVKQAAIDELTERANAKKVEFDNNPDATVEEKEAAKATIDNLVSEATTNIMNETTNNGVAQQKTSSIDSVNAATITPTVRSNARTAIDNIASARKVEIDKDNNATLEEKNAAKTEIDNLVARAKADINSLNHNNEIEILKENKVNEISQVEAHPVKKNAATQAIDQAAIAKKQEIDLIEDATIEEKEVAKAKVDKIVTEAKNNINQATTNSSVDDAQNEGITAINAVIPEVVKKSDARDTIDEVARIKKAAIDQTPDATVEEKEAAIAKIDQEVTKAKEQIHQALKNENVDTAKTNGTNFINAIQPEITKKIKAREAIDEVARAKKEAIDRIQDATTEEKETAKAKVDQAVTEAKGHINEAINNSGVDEAKTNGTTTINAIQPEVIKKSEARQAIDAAARAKKEAIDQTPDATTEEKEAAKAKVDQAVTEAKGHINEAINNSGVDEAKTNGTTTINAIQPEVIKKSEARQAIDNEVINKKTEIDNNVDATIEEKEAAKSKVDEAAVEAKNNINHTEINQAVDKAKEDGVTTVSHIQPNIVKKIAAKTAIDEVARIKKEAIDQTPGATTEEKEAAKSKVDEAATEARNNINRALSNNDVDQVVHNSTASINNIQPDIVKKEQAKRGIDTQAKIKKAIIDQISDATT

SEQ ID NO: 43009 - protein, 830 aa, Staphylococcus hominis SK119
AIDQIALTRKAIIDQTPDATEEEKEAAKSKIDEEVIKAKYGIDQAKTNNDVDQVEQNSTTMINNIQPTVVKKSEARQAIDDLAKLKKATIDLTQEATEEEKEAAKSKVDQALTEAKTHINEAENDDGVDNAKTKGINVINTIQLEIIKKVEAKHEIDQSAIAKKKIIDQTPDATEEEKEVAKQKVDEEATKAKDNIDQATTNDEVDQAKTTGNTEINNIQPEVVKKSLARQAIDEVAKVKKEKINQMLDATEEEKEAAKQKVDEEVIKAKNNINQATTNDGVNNAKTTGKNIIENIQPEVVKKAEARKAIDEAATLRKNLIDQDNSTTKEEKDIAKQKIDDEVNKAKRNVDQSINNSNVDHAQINGISAINNINAVALKKTQAKKSIDDEVTAKKAEIDSNHEATNEEKEMTKRKVDEAATKAKHNVDQSTTNDTVDQSTQIGISIISNIQPETIQKSLARQAIDDEATIKKAEIENNHNATKEEKDVARQKVDEEVIKAKNNIAQSTTNSDVEIAKESGKHAIDEIQPEIVKKSVAKQTIDELAKQKKAEIDQTPNATKEEKDAAKQKVEEAVMRAKKLLEGANTNSDVDQTTEQGKQSINSIQVEVIKKADALSKLEVELQKLKDKVSSDQTFTIDEKLFIKQKLDESYKKAEEKVNQAQTNKQVDNIKIHYLQEFNKIVLIDKVKLKAKSQIFDVANKRKAYIKGLTNISEYNRNKAYKQIDVYVMKALNKLAENVTTNDINELTRVTINEIEHVNVKQFENNFGLVNDNKVTFNNFNNKFNVNNNHSKLNTLPYTGENENSLLSLAEFTLLSGLLLLLKRRKKEDK

SEQ ID NO: 43010 - protein, 755 aa, Staphylococcus hominis
  subsp. hominis C80
MKKSENRYSIRKFSVGASSILVATLLFMGGGAAQAAETHQEVGNPESAVAQSIGDHKKQSDNQETQQDNVQSDEQATSTSQSVTNENEAQRLHNENKASTQVKDSTDQLNTNERTTDNIVTHQSTKHSVAETEEASTTKTSSDDPESVSTKEEQPSLETQESTKNTIQKDTLASDKKDNTTETSTTKNQAHSSENVTNESPTEEKTTTQTTTAETNTSSTKDNTSKTTDSHSTKTSQSTPLTESKELTPSKTQQDSNVNQDAIKNNDVEAPSTGKTNDTVDTTETKQTVTAKQPTDPAAPTVNTLNTKDEAISIDGTTNETVGHKDAKDQKNSQAGLETLANNAVATTNNTSQQQGTTETKDQTNKVAKHGQYKNQDPIILVHGFNGFTDDINPNVLSHYWGGDKLNIRQDLEQNGYNAYEASISAFGSNYDRAVELYYYIKGGTVDYGAAHAERYGHERYGKTYEGVYKDWQPGQKVHLVGHSMGGQTVRQLEELLRNGSQEEIEYQKTHGGDISPLLQGGHDNMVSSITTLGTPHNGTHAADELGNEALVRQVVFDLGKRLGNKNSRVDFGLSQWGLKQQPGESYISYLLRVKNSKLWQSKDNGFYDLTRDGATDLNRKTSLNPNIVYKTYTAEATHPTLIGKQKADYNMFLPFTVTGNVIGKATEKEWRENDGLVSVISSQHPFNQAYTEATDTNQKGIWQVTPTKHDWDHVDFVGQDSTDTKRSREELQQFWYDLADDLVQTEALTSTNEA

SEQ ID NO: 43011 - protein, 120 aa, Staphylococcus hominis
  subsp. hominis C80
MSDSNSASTSLSGSTSTSVSDSTSASTSSSESTSTSVSDSNSASTSLSGSTSTSSSEMQHSMHHAHSHSQLPKHHEDLPETGEENSNSSILVSAVATMLAGLGMIRRSRKNKKDNDRQRR

SEQ ID NO: 43012 - protein, 212 aa, Staphylococcus hominis
  subsp. hominis C80
MKKVSFVASTLLTSTMLLTTTQSVEAHTTNLVTKENAKQIATDALSNSGGNPNLQRLGRTVDKGDYFEIISHNRLNEGNGMYKVHKNGEVEYKNGRYSDFNQLQDTRIHAESGIAKAAKTTSSNHKQVNSVDCARELNRYYVGTVASSEVPSSKSLKDTQTSQSSVKTLPSTGDDTQQHSIQLLASLLLVMGTSLLLKQKHHSHSYLSTEHF
